US007638282B2

(12) United States Patent
Bakaletz et al.

(10) Patent No.: US 7,638,282 B2
(45) Date of Patent: Dec. 29, 2009

(54) **GENES OF AN OTITIS MEDIA ISOLATE OF NONTYPEABLE *HAEMOPHILUS INFLUENZAE***

(75) Inventors: Lauren O. Bakaletz, Hilliard, OH (US); Robert S. Munson, Jr., Hilliard, OH (US); David W. Dyer, Oklahoma City, OK (US)

(73) Assignees: Nationwide Children's Hospital, Inc., Columbus, OH (US); The Board of Regents of University of Oklahoma, Norman, OK (US)

( * ) Notice: Subject to any disclaimer, the term of this patent is extended or adjusted under 35 U.S.C. 154(b) by 138 days.

(21) Appl. No.: 11/770,447

(22) Filed: Jun. 28, 2007

(65) Prior Publication Data

US 2007/0264256 A1 Nov. 15, 2007

Related U.S. Application Data

(63) Continuation of application No. 10/795,159, filed on Mar. 5, 2004, now Pat. No. 7,241,867.

(60) Provisional application No. 60/453,134, filed on Mar. 6, 2003.

(51) Int. Cl.
*C12Q 1/68* (2006.01)
(52) U.S. Cl. ........................ 435/6; 536/23.7; 435/252.3; 435/320.1
(58) Field of Classification Search ........................ None
See application file for complete search history.

(56) References Cited

U.S. PATENT DOCUMENTS 6,797,273 B1 9/2004 Ruelle et al.

FOREIGN PATENT DOCUMENTS

WO WO 02/34768 5/2002

OTHER PUBLICATIONS

Ackerley, et al., "A genome-scale analysis for identification of genes required for growth or survival of *Haemophilus influenzae*," *Proc. Natl. Acad. Sci. USA* 99 (2):966-971 (Jan. 22, 2002).
Altschul, et al., "Basic Local Alignment Search Tool," *J. Mol. Biol.* 215: 403-410 (1990).
Anderson, et al., "Quantitative Filter Hybridisation," Chapter 4: 73-111, *Nucleic Acid Hybridisation: A Practical Approach*, IRL Press Limited, Oxford, England.
Anderson, P. et al., "Human Serum Activities against *Hemophilus influenzae*, Type b," *The Journal of Clinical Investigation* 51: 31-38 (1972).
Badger, et al., "Identification of *Escherichia coli* K1 genes contributing to human brain microvascular endothelial cell invasion by differential fluorescence induction," *Molecular Microbiology* 36(1): 174-182 (2000).

Bakaletz, et al., "Frequency of Fimbriation of Nontypable *Haemophilus influenzae* and Its Ability to Adhere to Chinchilla and Human Respiratory Epithelium," *Infect. Immun.*, 56(2): 331-335 (Feb. 1998).
Bakaletz, et al., "Evidence for Transudation of Specific Antibody into the Middle Ears of Parenterally Immunized Chinchillas after an Upper Respiratory Tract Infection with Adenovirus," *Clinical and Diagnostic Laboratory Immunology* 4(2): 223-225 (Mar. 1997).
Bakaletz, et al., "Modeling Adenovirus Type-1 Induced Otitis Media in the Chinchilla: Effect on Ciliary Activity and Fluid Transport Function of Eustachian Tube Mucosal Epithelium," *The Journal of Infectious Diseases 186*: 865-72 (1993).
Bakaletz, et al., "Relative immunogenicity and efficacy of two synthetic chimeric peptides of fimbrin as vaccinogens against nasopharyngeal colonization by nontypeable *Haemophilus influenzae* in the chinchilla," *Vaccine*, 15(9): 955-961 (1997).
Bakaletz, et al., "Protection against Development of Otitis Media Induced by Nontypeable *Haemophilus influenzae* by Both Active and Passive Immunization in a Chinchilla Model of Virus-Bacterium Superinfection," *Infect.Immun.* 67(6): 2746-2762 (Jun. 1999).
Baldwin, R.L., "Effects of Otitis Media on Child Development," *The American Journal of Otology* 14(6): 601-604 (Nov. 1993).
Baltes, et al., "*Actinobacillus pleuropneumoniae* Iron Transport and Urease Activity: Effects on Bacterial Virulence and Host Immune Response," *Infect. Immun.* 69(1): 472-478 (Jan. 2001).
Barenkamp, et al., "Outer Membrane Protein and Biotype Analysis of Pathogenic Nontypable *Haemophilus influenzae*," *Infect. Immun.* 36(2).535-540 (May 1982).
Bartilson, et al., "Differential fluorescence induction reveals *Streptococcus pneumoniae* loci regulated by competence stimulatory peptide," *Molecular Microbiology* 39(1): 126-135 (2001).
Berman, et al., "Theoretical Cost Effectiveness of Management Options for Children with Persisting Middle Ear Effusions," *Pediatrics* 83(3):353-363 (Mar. 1984).
Black, et al., "Efficacy, safety and immunogenecity of heptavalent pneumococcal conjugate vaccine in children," *Pediatr. Infect. Dis. J.* 19(3): 187-195 (2000).
Bosse, et al., "Urease activity may contribute to the ability of *Actinobacillus pleuropneumoniae* to establish infection," *The Canadian Journal of Veterinary Research* 64: 145-150 (2000).
Bright, et al., "The Prevalence of Tympanostomy Tubes in Children in the United States, 1988," *American Journal of Public Health* 83(7):1026-1028 (Jul. 1993).
Chiang, et al., "In vivo Genetic Analysis of Bacterial Virulence," *Annu. Rev. Microbiol.* 53: 129-54 (1999).
Chissoe, et al., "Strategies for Rapid and Accurate DNA Sequencing," *Methods: A Companion to Methods in Enzymology* 3(1):55-65 (1991).
Cimons, M., "Lurid Reports Obscure Reality of Strep A Outbreak," *ASM News* 60(10): 527-528 (1994).
Cormack, et al., "FACS-optimized mutants of the green fluorescent protein (GFP)," *Gene* 173:33-38 (1996).

(Continued)

*Primary Examiner*—Jennifer E Graser
(74) *Attorney, Agent, or Firm*—Marshall, Gerstein & Borun LLP

(57) ABSTRACT

The invention relates to the polynucleotide sequence of a nontypeable stain of *Haemophilus influenzae* (NTHi) and polypeptides encoded by the polynucleotides and uses thereof. The invention also relates to NTHi genes which are upregulated during or in response to NTHi infection of the middle ear and/or the nasopharynx.

8 Claims, 15 Drawing Sheets

OTHER PUBLICATIONS

Davis, et al., "Liposomes as adjuvants with immunopurified tetanus toxoid: the immune response," *Immunology Letters* 14:341-348 (1987).

DeMaria, et al., "Biotypes of Serologically Nontypable *Haemophilus influenzae* Isolated from the Middle Ears and Nasopharynges of Patients with Otitis Media with Effusion," *J. Clin. Microbiol.* 20(6):1102-1104 (Dec. 1984).

DeMaria, et al., "Immunization with Outer Membrane Protein P6 from Nontypeable *Haemophilus influenzae* Induces Bactericidal Antibody and Affords Protection in the Chinchilla Model of Otitis Media," *Infect. Immun.* 64(12):5187-5192 (Dec. 1996).

Devereux, et al., "A comprehensive set of sequence analysis programs for the VAX," *Nucleic Acids Research* 12(1):387-395 (1984).

Dhandayuthapani, et al., "Green fluorescent protein as a marker for gene expression and cell biology of mycobacterial interactions with macrophages," *Molecular Microbiology* 17(5):901-912 (1995).

Dunn, et al., "A vector for promoter trapping in *Bacillus cereus*," *Gene* 226:297-305 (1999).

Ehrlich, et al., "Mucosal Biofilm Formation on Middle-Ear Mucosa in the Chinchilla Model of Otitis Media," *JAMA* 287(13):1710-1715 (Apr. 3, 2002).

Erickson, et al. Chapter 3: "Solid-Phase Peptide Synthesis" in *The Proteins*, v.2, Academic Press, New York: 255-527 (1976).

Eskola, et al., "Potential of bacterial vaccines in the prevention of acute otitis media," *Pediatr Infect Dis J* 19 (5):72-78 (2000).

Eskola, et al., "Efficacy of a Pneumococcal Conjugate Vaccine Against Acute Otitis Media," *N Engl J Med* 344(6):403-409 (Feb. 8, 2001).

Eskra, et al., "*Brucella abortus* Genes Identified following Constitutive Growth and Macrophage Infection," *Infect. Immun.* 69(12):7736-7742 (Dec. 2001).

Fleischmann et al., "Histidine biosynthesis bifunctional protein hisB," UNIPROT: HIS7_HAEIN, Database accession No. P44327 (1995).

Fleischmann et al., "Whole-Genome Random Sequencing and Assembly of *Haetmophilus influenzae* Rd," *Science* 269: 496-512 (Jul. 28, 1995).

Fleischmann et al., "*Haemophilus influenzae* Rd KW20 section 45 of 163 of the complete geneome," EMBL: H132730, Database accession No. U32730, L42023 (1995).

Giebank, G.S., "Immunology: promise of new vaccines," *Pediatr Infect Dis J* 13(11): 1064-1068 (Nov. 1994).

Goosen, et al., "The regulation of transcription initiation by integration host factor," *Molecular Microbiology* 16(1):1-7 (1995).

Holmes, et al., "Adherence of non-typeable *Haemophilus influenzae* promotes reorganization of the actin cytoskeleton in human or chinchilla epithelial cells in vitro," *Microbial Pathogenesis* 23:157-166 (1997).

Infante-Rivard, et al., "Otitis Media in Children: Frequency, Risk Factors, and Research Avenues," *Epidemiologic Reviews* 15 (2): 444-465 (1993).

Jansen, et al., "Immunotoxins: Hybrid Molecules Combining High Specificity and Potent Cytotoxicity," *Immunological Rev.* 62:185-216 (1982).

Kaplan, et al., "Overall cost in the treatment of otitis media," *Pediatr Infect Dis J* 16(2):S9-S11 (Feb. 1997).

Karma, et al., "Immunological aspects of otitis media: present views on possibilities of immunoprophylaxis of acute otitis media in infants and children," *Int J Pediatr. Otorhinolaryngol.* 32(Suppl.):S127-S134 (1995).

Kennedy, et al., "Passive Transfer of Antiserum Specific for Immungens Derived from a Nontypeable *Haemophilus influenzae* Adhesin and Lipoprotein D Prevents Otitis Media after Heterologous Challenge," *Infect. Immun.* 68(5):2756-2765 (May 2000).

Klein, J.O., "Role of nontypeable *Haemophilus influenzae* in pediatric respiratory tract infections," *Pediatr Infect Dis J* 16(2):S5-S8 (Feb.1997).

Kramp, et al., "Liposomal Enhancement of the Immunogenicity of Adenovirus Type 5 Hexon and Fiber Vaccines," *Infect. Immun.* 25(2): 771-773 (Aug. 1979).

Lee, et al., "Constitutive and Inducible Green Fluorescent Protein Expression in *Bartonella henselae*," *Infect. Immun.* 66(8): 3964-3967 (Aug. 1998).

Lysenko, et al., "Bacterial Phosphorylcholine Decreases Susceptibility to the Antimicrobial Peptide LL-37/hCAP18 Expressed in the Upper Respiratory Tract," *Infect. Immun.* 68(3):1664-1671 (Mar. 2000).

Margolis, et al., "Identification of Hearing Loss in Children with Otitis Media," *Ann Otol Rhinol Laryngol* 103: 59-61 (1994).

Marra, et al., "Differential Fluorescence Induction Analysis of *Streptococcus pneumoniae* Identified Genes Involved in Pathogenesis," *Infect. Immun.* 70(3):1422-1433 (Mar. 2002).

Marra, et al., "In vivo characterization of the *psa* genes from *Streptococcus pneumoniae* in multiple models of infection," *Microbiology* 148: 1483-1491 (2002).

Matteucci, et al., "Synthesis of Deoxyoligonucleotides on a Polymer Support," *J. Am. Chem.* 103:11:3185-3191 (1981).

Mhlanga-Mutangadura, et al., "Evolution of the Major Pilus Gene Cluster of *Haemophilus influenzae*," *J. Bacteriol.* 180(17): 4693-4703 (Sep. 1998).

Mitchell, et al., "Electroporation of *Haemophilus influenzae* is effective for transformation of plasmid but not chromosomal DNA," *Nucleic Acids Research* 19(13): 3625-3628, Oxford University Press (1991).

Miyamoto et al., "Selective adherence of non-typeable *Haemophilus influenzae* (NTHi) to mucus or epithelial cells in the chinchilla Eustachian tube and middle ear," *Microbial Pathogenesis* 21: 343-356 (1996).

Musher et al., "Opsonizing and Bactericidal Effects of Normal Human Serum on Nontypable *Haemophilus influenzae*," *Infect. Immun.* 39:(1): 297-304, Jan. 1983.

Musser, et al., Genetic Relationships of Serologically Nontypable and Serotype b Strains of *Haemophilus influenzae*, *Infect. Immun.* 52(1):183-191 (Apr. 1986).

Nichols, et al., "Identification of the ADP-$_L$-glycerol-D-manno-Heptose-6-Epimerase (*rfaD*) and Heptosyltransferase II (*rfaF*) Biosynthesis Genes from Nontypeable *Haemophilus influenzae* 2019," *Infect. Immun.* 65(4):1377-1386 (Apr. 1997).

Novotny, et al., "Epitope Mapping of the Outer Membrane Protein P5-Homologous Fimbrin Adhesin of Nontypeable *Haemophilus influenzae*," *Infect. Immun.* 68(4):2119-2128 (Apr. 2000).

Papp, C.M., "Management of Otitis Media with Effusion in Young Children," *Ann Pharmacother* 30: 1291-1297 (1996).

Padmalayam, et al., "Molecular Cloning, Sequencing, Expression and Characterization of an Immunogenic 43-Kilodalton Lipoprotein of *Bartonella bacilliformis* That Has Homology to N1pD/LppB," *Infect. Immun.* 68(9): 4972-4979 (Sep. 2000).

Poolman, et al., "Developing a nontypeable *Haemophilus influenzae* (NTHi) vaccine," *Vaccine* 19:S109-S115 (2001).

Ray, et al., "Tricross: using dot-plots in sequence-id space to detect uncataloged intergenic features," *Bioinformatics*, 17(12):1105-1112 (2001).

Rock, et al., "The *licC* gene of *Streptococcus pneumoniae* Encodes a CTP: Phosphocholine Cytidylytransferase," *J. Bacteriol.* 183(16): 4927-4931 (Aug. 2001).

Sawitzke, et al., "Suppression of chromosome segregation defects of *Escherichia coli muk* mutants by mutations in topoisomerase I," *Proc. Natl. Acad. Sci. USA* 97(4): 1671-1676 (Feb. 15, 2000).

Schneider et al., "Virulence Gene Identification by Differential Fluorescence Induction Analysis of *Staphylococcus aureus* Gene Expression during Infection-Simulating Culture," *Infect. Immun.* 70(3): 1326-33 (2002).

Snow, Jr., J.B., "Progress in the Prevention of Otitis Media through Immunization," *Otology & Neurology* 23: 1-2 (2002).

Spinola, et al., "Epidemiology of Colonization by Nontypable *Haemophilus influenzae* in Children: A Longitudinal Study," *The Journal of Infectious Diseases* 154(1): 100-109 (Jul. 1986).

Suzuki, et al., "Synergistic Effect of Adenovirus Type 1 and Nontypeable *Haemophilus influenzae* in a Chinchilla Model of Experimental Otitis Media," *Infect. Immun.* 62(5): 1710-1718 (May 1994).

Teele, et al., "Otitis Media in Infancy and Intellectual Ability, School Achievement, Speech, and Language at Age 7 Years," *J. Infect. Dis.* 162:685-694 (Sep. 1990).

Tomb, J-F., "A periplasmic protein disulfide oxidoreductase is required for transformation of *Haemophilus influenzae* Rd," *Proc. Natl. Acad. Sci. USA* 89:10252-10256 (Nov. 1992).

Tong, et al., "Evaluation of Phase Variation of Nontypeable *Haemophilus influenzae* Lipooligosaccharide during Nasopharyngeal Colonization and Development of Otitis Media in the Chinchilla Model, " *Infect. Immun.* 68(8): 4593-4597 (Aug. 2000).

Valdivia, et al., "Bacterial genetics by flow cytometry: rapid isolation of *Salmonella typhimurium* acid-inducible promoters by differential fluorescence induction," *Molecular Microbiology* 22(2): 367-378 (1996).

Valdivia, et al., "Fluorescence-Based Isolation of Bacterial Genes Expressed Within Host Cells," *Science* 277: 2007-2011 (Sep. 26, 1997).

Valdivia et al., "Flow cytometry and bacterial pathogenesis," *Current Opinion in Microbiology 1*: 359-363 (1998).

van Ulsen et al., "Genes of non-typeable *Haemophilus influenzae* expressed during interaction with human epithelial cell lines," *Molecular Microbiology* 45(2): 485-500 (2002).

Weiser et al., "Decoration of Lipopolysaccharide with Phosphorylcholine: a Phase-Variable Characteristic of *Haemophilus influenzae*," *Infect. Immun.* 65(3): 943-950 (Mar. 1997).

Weiser et al., "Phosphorylcholine on the Lipopolysaccharide of *Haemophilus influenzae* Contributes to Persistence in the Respiratory Tract and Sensitivity to Serum Killing Mediated by C-reactive Protein," *J. Exp. Med 187*(4): 631-640 (Feb. 16, 1998).

Wilson et al., "Identification of *Listeria rnonocytogenes* In Vivo-Induced Genes by Fluorescence-Activated Cell Sorting," *Infect. Immun.* 69(8): 5016-5024 (Aug. 2001).

Yamanaka, et al., "CspD, a novel DNA replication inhibitor induced during the stationary phase in *Escherichia coli*," *Molecular Microbiology 39*(6): 1572-1584 (2001).

Young, et al., "A Bifunctional Urease Enhances Survival of Pathogenic *Yersinia enterocolitica* and *Morganella moganii* at Low pH," *J. Bacteriol. 178*(22): 6487-6495 (Nov. 1996).

Zhang, et al., "Structure of *Thermotoga maritima* Stationary Phase Survival Protein SurE: A Novel Acid Phosphatase," *Structure* 9:1095-1106 (Nov. 2001).

Cardillo et al., "Synthesis of the phenylserine-leucine dipeptide fragment present in the antibiotic lysobactin from an aziridine-2-imide precursor," *Eur. J. Org. Chem.*, 2489-2494 (2000).

Green et al., "Certain-site directed, nonenzymatically active mutants of the *Haemophilus influenzae* P4 lipoprotein are able to elicit bactericidal antibodies," *Infection and Immunity*, 73:4454-4457 (2005).

Gritsun et al., "Analysis of flavivirus envelope proteins reveals variable domains that reflect their antigenicity and may determine their pathogenesis," *Virus Research*, 35:307-321 (1995).

Shen et al., "Molecular determinants of disease and resistance in interactions of *Xanthomonas oryzae* pv. *oryzae* and rice," *Microbes and Infections*, 4:1361-1367 (2002).

Partial European Search Report for EP08003400, dated Apr. 11, 2008.

Figure 3A

SEQ ID NO: 589

TTNAACAAGANATTGGGACAACTCCAGTGAAAAGTTCTTCTCCTTTACTCA
TATGTATATCTCCTTCTTAAATCTAGAGGATCAAGCAACTTAATTTTTGGT
TTGCGACATAGACAATTTTCTTCGGGCTTATGCGGGCAAATGAGTACTTCA
TCAAAGGTAATGCCCTGAGATTCAAATAATGCCATCATTACATTGTGGGG
CTTATCAAAATTTGTTTGCGGAAAAGCATCCGTACCAAGCCCATCTTGATT
AGAAACTATCACAAAACGGTATTTCGCTTTCAGTCTGAGGAGTGCGGGAA
TCACTTTCGGTTCTAATTTTAGTTTCTCTAAACTGTCAATTTGGAAATCAGT
TTTTGGTTCATCAATTAATGTGCCGTCTCGGTCGATAAAAGAGTAGGTTG
CATATTTTCTCCGTGTATGTTATATGAATGGTATGAGGTTTATCATTTGCT
TTATACAAACAGTATAAAACTAAATAATCTCGAATCGCTCTGTGACTTAA
ATAGGAGGTGGTTCATTTTACCTCCTTAATTGCTTCAACAACTTTCTCACA
CTCATTCCTTGTTCCCACAGTAATGCGAATACAATTTTGT

Nt 80-410 of SEQ ID NO: 589 corresponds to compliment of nt 1-331 of the *hisB* gene.
Nt 80-600 of SEQ ID NO: 589 corresponds to nt 4655-5175 of the contig 532 (SEQ ID NO: 532).

SEQ ID NO: 590

TAACAAGAACTTGGGACAAAGNCCAGTGAAAAGTTCTTCTCCTTTACTCA
TATGTATATCTCCTTCTTAAATCTAGAGGATCAGCATCACATCGGGCGGAA
TAGGAAAAAATATCGCCTCGATAAAACTTACAAAAGAGAGCCAAAAAAC
AGCAAAACGATGTTTTGACCATTCCATCGTTTTATCGTACATCGTGCCGAA
AATTTTCATATTTTTCTCTATTTGGTAAATTCCTGCTCTAACCAATTTTGCA
AAGAAAGCAATGAATGATATGCGGTAAGATCCTCTAGAGTCGACCTGCAG
GCATGCAAGCTTGGCGTAATCATGGTCATAGCTGTTTCCTGTGTGAAATTG
TTATCCGCTCACAATTCCACACAACATACGAGCCGGAAGCATAAAGTGTA
AAGCCTGGGGTGCCTAATGAGTGAGCTAACTCACATTAATTGCGTTGCGC
TCACTGCCCGCTTTCCAGTCGGGAAACCTGTCGTGCCAGCTGCATTAATGA
ATCGGCCAACGCGCGGGGAGAGGCGGTTTGCGTATTGGGCGCCAGATACC
GGCCTCCATCGGAGAAACTGTCCGAGGTTATGTTGACCTGCAGGG

Nt 78-210 of SEQ ID NO: 590 corresponds to compliment of nt 1-133 of the *lppB* gene.
Nt 78-285 of SEQ ID NO: 590 corresponds to compliment of nt 1423-1630c of the contig 442 (SEQ ID NO: 442).

Figure 3B

SEQ ID NO: 591

NACAGATTGGGACAACTCCAGTGAAAAGTTCTTCTCCTTTACTCATATGTA
TATCTCCTTCTTAAATCTAGAGGATCCACAATAATATGTTCTATCTTGGCTT
CTTTTTTCCAATAGTTTTCGTTACGCACTAAGCGAACATATTGGTTATATA
CATAATCTTTTACTTGATAAGGCCCTGTGCCTACTGGGTGGGTATCTAATT
GAGCAAGGTTGTCATCTGCGCTTAATTGATAGGCATATTCTTGTGAAAAA
ATAATGGCATACTGGCTGGCAAGATGCGACAAAATGGAGGAATCTGGTGC
AAATAATTCAATTTTTACTTGATAAGGCGAAAGTGCGGTCACAGATTTGAT
TTTTTCGTTAAGTTTAATGCTATCAAAATAAGGAAAACGCACTTTTCTTGC
TTGTTCGTGAAACACTCTATATTGTGGATTACTATAGGNAACCATNCGCCT
CTGCTAAGGTTGGTAAATAAGTATTATGCCCTAATACACGATTAATCGAA
AATACTTCNGTNTTCAGNGNTAAAAACACCNTGNNGGGGNAAANCNANG
GGGTTTGGGGGAAATTTTACCCCCGGGACGTAAATTNAATAAA

Nt 74-514 of SEQ ID NO: 591 corresponds to compliment of nt 369-811 of the *sapA* gene.
Nt 74-514 of SEQ ID NO: 591 corresponds to nt 3458-3897 of the contig 512 (SEQ ID NO: 512).

SEQ ID NO: 592

TTAACAAGNAATTGGGACAACTCCAGTGAAAAGTTCTTCTCCTTTACTCAT
ATGTATATCTCCTTCTTAAATCTAGAGGATCGTAGAACCATAAGGTTTTAC
CATCAGAAATAATCTGGGTTTCTTGAGGGGTTTTAGTCTCCATACGGAATA
AATTTGGGCGTTTAATTTGAAGTTTGCCACTTCCTTGTTGAACATTTTTCC
ACTTCCAGAAGTCACTGTTTGCACAAATTCTGCACTTAATACATCGACTTT
AGCTAAACGCATTTGTAATTCACTTGCCGCATCAGCCAATGCCAAATTACT
CAAACCAAGTAAGGTAAGTGCGGCAAATTTTAAGGTTGTTTTTTTCATTTT
ACTTTCCTTTTAAATTAGTATTCTGGACGATGCGATAAAATTTCACGCTTA
CCATTTGCATTGGGCTGACAATCCCTTGCTCTTCCATTTGATCCTCTAGAG
TCGACCTGCAGGCATGCAAGCTTGGCGTAATCATGGTCATAGCTGTTTCCT
GTGTGAAATTGNTATCCGNTCACAATTCCCACAACATACGAGCCNGAAGC
ATAAAGTGTAAAGCCTGGGGGGNCTNATGAGGGAGCTA

Nt 78-345 of SEQ ID NO: 592 corresponds to the compliment of nt 11-278 of the *lolA* gene.
Nt 78-454 of SEQ ID NO: 592 corresponds to compliment of nt 1039-1415 of the contig 360 (SEQ ID NO: 360).

Figure 3C

SEQ ID NO: 593

TTAACAGAATTGGGACAACTCCAGTGAAAAGTTCTTCTCCTTTACTCATAT
GTATATCTCCTTCTTAAATCTAGAGGATCTATACCTGCAATTAAAATAACG
AAAGTCATACCCACTGCAATAATCGCATTAACCGAAGTTTGGCGTAAAAT
ATTCAAAATATTATCTACGCTAAAAAAATCAGGATTAATCATTGATACAA
TCGCGATAAGAATAATCAACGCAATAAAAGAACGCTGTTCAATCAAAAAT
CTTCCTATTTGAAAATTAGATGTTTCATTTTTCATCATACTTACCTACTCTT
ATTTACCAATAGCTGCTGCTAATAATTTTTCTTGAGTTGCGTCTTTGCGAG
AAAATTCTGCACTAATTTTACCTTCACGCATTACCAACACTCTATCGCTCA
TACCAAGCACTTCTGGCATATCAGATGAGATCCTCTAGAGTCGACCTGCA
GGCATGCAAGCTTGGCGTAATCATGGTCATAGCTGTTTCCTGTGTGAATT
GNTATCCGNTCACAATTNCACACAACATACGAGCCNGNAGCATAAAGGG
GAANNCCGGGGGGCCTAANGGGGNGCTACNNNATTNATNGGGTG

Nt 77-290 of SEQ ID NO: 593 corresponds to compliment of nt 1-214 of the *rbsC* gene.
Nt 77-438 of SEQ ID NO: 593 corresponds to compliment of nt 1813-2174 of the contig 445 (SEQ ID NO: 445).

SEQ ID NO: 594

AAGTACTCTGTNTNTCTCCTTCTTAAATCTAGAGGATCGGGATTATCAAGC
ACATTACTCGTTTGGCTTTCACGGAAAGATTGCAAGCGTGAAAGCAACTT
CTGCATCCCAACTTGCTAGAATTTGTGCGGCTAACAATCCAGCATTTGCCG
CACCCGCAGGGCCAATAGCCAATGTTCCGACTGGGATTCCTTTTGGCATTT
GCACAATTGAATAAAGGCTATCTACGCCACTTAACATAGAACTTTTACTG
GCACACCCAGCACAGGCACAAGGGTTTTGGCTGCGATCATGCCGGGTAAA
TGTGCCGCACCGCCAGCCCCAGCAATAATTACTTTATAGCCATTTTTTTGT
GCATTTTCAGCAAATTCAAAAAGTTTATCAGGCGTACGATGAGCAGAGAC
GATTTCCACATGATAAGGTACTTTTAATTCATCTAAAATCTGAGTTGCCTC
TTGCATGGTAGCCCAATCGCTTTTGGAACCCATCACAACAGCAATTTGTGC
AGTTTTTGACATGCTATTTTCTCAATTTTCTAATTAAAAAGGTGGCGTAGA
ATAGCATAGATTACATATATTGAGCAAACGTTTGCTATNTAT

Nt 105-519 of SEQ ID NO: 594 corresponds to compliment of nt 1-415 of the *purE* gene.
Nt 34-281 of SEQ ID NO: 594 corresponds to compliment of nt 286-40 of the contig 536 (SEQ ID NO: 536).

Figure 3D

SEQ ID NO: 595

TTATGNGACCNTGGGACAAGTCCAGTGAAAAGTTCTTCTCCTTTANTCATA
TGTATATCTCCTTCTTAAATCTAGAGGATCTTCATCATCTAAAACTAATAC
GCCAGTTCCATGTTTGAAAGCATTAATTGCATTAAGTACGCGTTCTTCAGC
GGTGTTGCCGAATGGAGATAAAATTGACTGATTCATAGTAATTTCCTAATT
TGAGATTTCAATTAAATACCAGAATCAGGGCTGAGAAATGCAAATAAAAT
GAACGATTTGGGAACCCAACTCGTTTTATTCTCTTTCATCCAGACTTTACT
GTCGGCTTTGGAATTTCACCAAATCTGCTGACTTTAAAAGTGAAAATCAG
GACAATTTCGCAGGAAAAATTTGCCAAAAATTGACCGCACTTTTAAACGC
TCGTGGGCTTTACCACCGGTAGGGAATTTCACCCTGCCCTGAGAATGCGA
GCTAAGTATAACGCAAAATACCTAGGCACTAAATCAGAACGTGAAAAATA
TTTTCATTTAGCCTACAATAAACACACTCAATTCTTACGCTATCAAGAGCA
GATTATGTCAAAAACAAAAGAGAAAAAGTCGGTGTCATTTTCG

Nt 78-189 of SEQ ID NO: 595 corresponds to compliment of nt 1-112 of the *ribB* gene.
Nt 237-565 of SEQ ID NO: 595 corresponds to compliment of nt 2216-2544 of the contig 290 (SEQ ID NO: 290).

SEQ ID NO: 596

TNACAGNAATTGGGACAACTCCAGTGAAAAGTTCTTCTCCTTTACTCATAT
GTATATCTCCTTCTTAAATCTAGAGGATCTAAGAGATATTTAATTTCACGT
TCTGTGTGATGAACAAGACTAAGTAAATGTCTATTTTTCATATTGAAAGCC
ATAATAATCTCCTTGTGTTTTGACTATACATTGGGGAATAAACATACATCA
TTCGAGATACTGCTTGTTGTTCAACAGTTGCATTATAAGAGAGGTAAAAT
GAAATTTGTTGTCGTTTTCAACTGGTAATGCCAGTATGTAGAATTTTATT
GCGAGATTTTAGTATTATTAGAATTTAATAAAAATAATCTAACTCTTTAT
TGTTATTTGTTTGATTTCTAATAGTAGATGAATTTAAACGAAATATGTTT
TAGTTTATTTTTGATGAAGAGGAATGNGTCTATCTATNCTTAATAAAAGNG
CGGNTATTTTTATTGNAGNTTTTAATATATTGATCCTNTAGAGAGCGACCC
NCACGCNTGCGCNCTTGGGGCGANCATGGGGCATATAGTTGTTCCCTGTG
NNAANGTGTTATCCGTTCACANTTCCCCACAAAANACGAN

Nt 77-155 of SEQ ID NO: 596 corresponds to compliment of nt 1-79 of the *arcB* gene.
Nt 77-494 of SEQ ID NO: 596 corresponds to compliment of nt 772-1189 of contig 461 (SEQ ID NO: 461).

Figure 3E

SEQ ID NO: 597

AACAGNATTGGGACAACTCCAGTGAAAAGTTCTTCTCCTTTACTCATATGT
ATATCTCCTTCTTAAATCTAGAGGATCAGTACGAGTCCAGTCTAAAACAG
GCATAAAATTGTAACAAACAGTGTCAATTCCGCATTGAGCAAGCATTGCG
AGAGAGTTTGTTTATAGTTATTAATCCATTTTGATAATTTCCAGTACTGA
GTTTTAATCTCTTCATGAACTGGTACACTTTCCACTACTGACCAGCTTAAA
CCAGCATTCTCTATTTCAGTTTTGCAGTTTTTAATTTCTTCGATACTCCAC
ACTTCACCGTTAGGAATATGGTGAAGTGCAGTGACTATACCAGTTGCGCC
TGCTTGACGAATATCAGATAAAGAAACAGGATCCTCTANAGTCGACCTGC
AGGCATGCAAGCTTGGCGTAATCATGGTCATAGCTGNTTCCTGTGNGAAA
CTGGTATCCGCTCACAATTCCACCNAACATACGAGCCNGAAGNCATAAAG
NGNTAANCCNTGGGGNGCCTAATGAGTGAGCTAACTCACATTAATTGNGT
TGGGCTTACTGCCCGTTTTCAGNNGGGAAACCTGGCGCGCCAGCT

Nt 83-388 of SEQ ID NO: 597 corresponds to compliment of nt 34-335 of the *uxuA* gene.
Nt 156-388 of SEQ ID NO: 597 corresponds to compliment of nt 779-1008 of the contig 5 (SEQ ID NO: 5).

SEQ ID NO: 598

TNACAAGNAATTGGGACAACTCCAGTGAAAAGTTCTTCTCCTTTACTCATA
TGTATATCTCCTTCTTAAATCTAGAGGATCAACCTCGTAACTTAGCAAAAT
CAGTTACCGTTGAATAAAGTGCGGTTGATTTTAATGTAATAAAAAAAACG
GTGAAATTTCACCGTATTTTTTAGTTAAATAATCTTCTTTGTTTCCGTGTT
TTAATCACTTGTGCGATTAACAATAATGTGAGAATAACCACATATAGTGA
AAAAATAACCACTAGCCATTGCACCATCGTTAAACCAAATAATGACCATT
GGCTTTCATTACAAGAGCCAGTTGGGTTAAATATAAATGGAAACCATTGA
TGAAATGGTAAAGTCTCGGGAAAATTTGGAATAAACTCACATTGTTTCCA
AGGAGCTGGATTCATTTGCAAATCAAGATGACGAAATGAAATCAATAAGC
CCTTAATACTGCTGAATAAACCTAAAGCCAAGGCGATTAATCGAAGTATG
AAAGCAAGAGGTTGAAGTAATGCAATAATGCCCGCTACAAATAAGCCAAT
CATTGCTAAACGTTCATAAACACAGAGCACACAAGGTTGTAAGCCC

Nt 176-600 of SEQ ID NO: 598 corresponds to compliment of nt 108-532 of the *dsbB* gene.
Nt 78-600 of SEQ ID 598 corresponds to nt 819-1341 of the contig 560 (SEQ ID NO: 560).

Figure 3F

SEQ ID NO: 599

NACAAGATTGGGACAACTCCAGTGAAAAGTTCTTCTCCTTTACTCATATGT
ATATCTCCTTCTTAAATCTAGAGGATCGCCCGCCAGCACCCCAGGGGAGG
AGGACATCTGCATCGCATTCAAGCCATTCGCCCACGCATCATCGTAACTTG
GCAACGTTATCACTTTAAACGGTGGCGTCGCAAAGTATTCAGCAAGCTGG
GTTTTACCGCTGGAGGAAAGTTTGGTGGAAAGGGATAATTTGCTGTTCAT
AGATTTTGTAGGGGCTAATTACATTAGCCCCGATATTTCACCAATAATTGG
GCAAATGTAATTTGCCCCTACGATTAACGAACCAAAGATGCAGGTTCTTC
CACATTCTTCAACAACGCATATTTTCGATCCTCTAGAGTCGACCTGCAGG
CATGCAAGCTTGGCGTAATCATGGTCATAGCTGTTTCCTGTGTGAAATTGT
TATCCGCTCACAATTCCACACAACATACGAGCCGGAAGCATAAAGTGTAA
AGCCTGGGGTGCCTAATGAGTGAGCTAACTCACATTAATTGCGTTGCGCTC
ACTGCCCGCTTTCCAGTCGGGAAACCTGTCGTGCCAGCTGCATT

Nt 75-252 of SEQ ID NO: 599 corresponds to compliment of nt 1-178 of the *ureH* gene.
Nt 75-385 of SEQ ID NO: 599 corresponds to nt 825-1135 of the contig 258 (SEQ ID NO: 258).

SEQ ID NO: 600

TANACAAGNAATTGGGACAACTCCAGTGAAAAGTTCTTCTCCTTTACTCAT
ATGTATATCTCCTTCTTAAATCTAGAGGATCCAATCTCAATACGTATTACT
TGCCCATTACTATTTAAAATCGGTAGCCATTCATTGTGCGTTTTAGAACGG
ATAACCGTGAAATATTTGCTGTGTGATGGTTTCGTTAGAAAAATATTACGA
TTAAGCACTACATCCGCATCAATAACATAACAATCACTAAAGAAGTCTTG
TGCCAGAGAAAAGGAATAAATGCTGTTATATTCGCGATATTTTTCGTTGTA
AATCAAGGTGCAGTCATATTTTTTCTTTAGATACTCGAATTGTTCGTGTAA
ATACCCTGTAACAATGACAATATTGTCGATATTTGCTTGACGTAGAAAAGT
GAGTGTCCGTTCTAAGTTAGGTGTGCCGTGAATATCTAACAATGATTTATG
TGTGCTTTGTGTGATGTCTTTAAAACGACCGGCTTANTCNTGCAGCTAAAA
TAATCGCATTCATTTTGTTCCCCTTTGNAAAAAAGTGTACCGATCCTCTA
GAGTCGACCTGCAGGCATGCAAGCTTGGCGTAATCATGGN

Nt 82-482 of SEQ ID NO: 600 corresponds to compliment of nt 40-440 of the *licC* gene.
Corresponding sequence not in contig set.

Figure 3G

SEQ ID NO: 601

TNACAAGANTTGGGACAACTCCAGTGAAAAGTTCTTCTCCTTTACTCATAT
GTATATCTCCTTCTTAAATCTAGAGGATCGCTCATTCGAGAGACACCTCCA
ACAGCACGAATATCTGCAGGAATTCGTTCCAAAGCCATCACTGCAGCTGC
ACCAGCAGCTTCTGCAATGCGAGCTTGTTCAGGGTTTTGAACATCCATGAT
AACACCACCTTTGAGCATCTGTGCTAAGTTTTTATTTAGTTCATAACGATT
TTCAGCCATTTCTTTGTCCTCATTATTTGGTTATTTGTATTGATAGCTACGT
TTTTTATTGTAATGTAGAAAAGTCTTTAGAACAAGTTTGAAAAAATGCGTA
TATATTAAAAGGCATAATGTCTAGTGTGCTTAATTTCAGTTTTTTGTATAA
ACGAAGTGTAGAACGTCAGAAGGATTGTCCAATTTAATAATAGAAAAAAG
AGCTACTTTAGCTGAAAGAATTTCGTCCTTAAGTGCCACAATAGTTATTAA
AAAAACCTTGAAATGTTTTAAAAACCTTTTTCTATGTGGTTAGATTTTCT
GAAATTTAAGAAAAGCTTGAAAGGGAGTTTACGCTTTCC

Nt 75-263 of SEQ ID NO: 601 corresponds to compliment of nt 1-189 of the HI1647 gene.
Nt 75-600 of SEQ ID NO: 601 corresponds to compliment of nt 1035-1560 of the contig 471 (SEQ ID NO: 471).

SEQ ID NO: 602

TTNACAAGGAATCGGGACAACTAGCAGTGAAAAGTTCTTCTCCTTTACTA
CATATGTATATCTCCTTCTTAAATCTAGAGGATCTGCAAAATTGTTGCAAC
CACTAATACGATGGCTGCTTCACGTACACCACCGAGTTTGTAAGTGATAA
AAAATAAAATTAAAGGGATAAAGTCAAGGAGTTGTTTCATATTGATTAAT
CCTTCATAAATAAGCTGTAGAAACGATAAGTCACTACTAGCATGAAAATA
TTAAGTAATGCGGTGAAAATGCCTATTACCATATCAAATATAGCATTATTG
GAAAATGCGCTTAATTGGAAAATAAGAATTGGCACGAGAAAATAAACCA
GTAGGGTGTAAATAAACAATACGCCTTTTCGAGTATTTCCTCGCATCCAAA
TTTTTCGGATAGTTTGCGAAAGTGCCTCTTGAGTAGAAAGATAATGTACTA
CCGTTAAATTTTAAACGGACAAAGAACCAAACGCCAACAAGCATCGCGAT
AAGTGACATAATAGAGGGCGATTTTTTTGTGAGTAATGCANCAAAGGCTT
CACCAAGNACCAGTAACATTGGTGCAACCATTAATAGATCCTCTTAG

Nt 81-191 of SEQ ID NO: 602 corresponds to compliment of nt 1-111 of the *ispZ* gene.
Nt 81-593 of SEQ ID NO: 602 corresponds to compliment of nt 850-1361 of the contig 418 (SEQ ID NO: 418).

Figure 3H

SEQ ID NO: 603

NACAAGANTTGGGACAACTCCAGTGAAAAGTTCTTCTCCTTTACTCATATG
TATATCTCCTTCTTAAATCTAGAGGATCCTTGAAACATCACCTCAGATTTA
ATCAATCTGTGGATTCTATCCAAGAAAAGTACCACGAATTTTCTCTTTCC
TCATTACCTATAATGGTTTGAAAATAGAGTTTAGCTATTGATGGCTCAGTA
AATTCCTGTGCACCTTGGTAAAAGGGCTTTTCTTCCATCACTTTAGTTAAA
ATAACCTGTGCCTGTTCTAAAATAGCTTGTTGTTGCTCGTTTAATTTAAAC
ATTCGATATTCCTTCTAAAATAGGGAATATCGCCCATAAGGGATATATCCC
CTATGGGTAAGGTGCGAAAAGAATGCTTATCGCACATTAAAGTTAATGTT
ATTAATCAGAAGTTTTTAAACTGTCGATAATCTGTTTAATTTTTGCTGCAA
ATTCTAAATCGTGCTCAGATTCATCATCTATACAATATTCCAAATAATTAC
TCATATCAGCAATTAGTGCTTCTTTTGTTGGCGAAGGTTGGAACATAATTG
ATCCTCTAGAGTCGACCTGCAGGCATGCAAGCTTGGCGTA

Nt 65-525 of SEQ ID NO: 603 corresponds to compliment of nt 18-477 of the *radC* gene.
Nt 76-564 of SEQ ID NO: 603 corresponds to compliment of nt 23606-23869 of the contig 575 (SEQ ID NO: 576)

SEQ ID NO:604

TTAACAAGNAATTGGGACAACTCCAGTGAAAAGTTCTTCTCCTTTACTCAT
ATGTATATCTCCTTCTTAAATCTAGAGGATCGGCTTCTAACATTTCGCCGT
CTAAACGTTCGTTGTTATAAATTGCAATCGCCAGCAGGAAAACCAAGCGT
TCGGTAGGTAAATTCAAAGAAAACTCGCGATCTTTTGCCCAAGAGACGAG
TTCAGGAATAGTTTGGGATGTTTCAATCATTGAATTGCAAAGCGTTAAAAT
TGAACAAAAAATTGGAAAGATTATACAGGATTTTTTGCGGATCCTCTAGA
GTCGACCTGCAGGCATGCAAGCTTGGCGTAATCATGGTCATAGCTGTTTCC
TGTGTGAAATTGTTATCCGCTCACAATTCCACACAACATACGAGCCGGAA
GCATAAAGTGTAAAGCCTGGGGTGCCTAATGAGTGAGCTAACTCACATTA
ATTGCGTTGCGCTCACTGCCCGCTTTCCAGTCGGGAAACCTGTCGTGCCAG
CTGCATTAATGAATCGGCCAACGCGCGGGGAGAGGCGGTTTGCGTATTGG
GCGCCAGATACCGGNCTCCATNGGANAAACNGTCCCAGGGTNTNT

Nt 79-296 of SEQ ID NO: 604 corresponds to compliment of nt 30-247 of the *mukF* gene.
Nt 79-296 of SEQ ID NO: 604 corresponds to compliment of nt 4026-4243 of the contig 508 (SEQ ID NO: 508).

Figure 31

SEQ ID NO: 605

TAACAGNATTGGGACAACTCCAGTGAAAAGTTCTTCTCCTTTACTCATATG
TATATCTCCTTCTTAAATCTAGAGGATCCACGTAATCAGAATTTTCTGCAG
AAGATGGCGATGCCGCACCACCGTGATGGCGGCGAATTAAATCTAACTCC
GCCAAAATATTCAAATCACGACGAATCGTTTGAGGGCTAACATCTAAGGC
AGCAACCAATTCTTCCGTGCTTAAATAGCCAGATTGTTCCACCAGTTTAAT
AATTTTTTGATGGCGTAACGATTGTTTCATAGCGAATCCTTTATCCAAATT
AAACGGACTTACTCTAGCGAATTTTGCGCAATTTGCTATCAATAAATCCC
CAAATCAAGCCGACAATCAAGCCTGAAATATGTGCAGCATTTCCCATTTC
AACACCAAATAAGGGGCTAATAAAACCTAATGCGATCCTCTAGAGTCGAC
CTGCAGGCATGCAAGCTTGGCGTAATCATGGTCATAGCTGTTTCCTGTGTG
AAATTGTTATCCGCTCACAATTCCACACAACATACGAGCCGGAAGCATAA
AGTGNAAGCCTGGGGNGCCTAAGGGTGAGCTAACTCACATTATT

Nt 76-283 of SEQ ID NO: 605 corresponds to compliment of nt 1-208 of the *glpR* gene.
Corresponding sequence not in contig set.

SEQ ID NO:606

TAACAAGAATTGGGACAACTCCAGTGAAAAGTTCTTCTCCTTTACTCATAT
GTATATCTCCTTCTTAAATCTAGAGGATCACCATTTTCAAGAGATTGAGAA
ATAAACTCTAAAATATCTTTTACCATATTTTCAATTTCTTTTGCAGATAAA
GTTGGCTGTTTTGCTGACAATTTTTCCATAAGTTCTGACTTAGTCATCCTCT
ATACTTCCTTAATATTATTTAAATTAAGATCCTCTAGAGTCGACCTGCAGG
CATGCAAGCTTGGCGTAATCATGGTCATAGCTGTTTCCTGTGTGAAATTGT
TATCCGCTCACAATTCCACACAACATACGAGCCGGAAGCATAAAGTGTAA
AGCCTGGGGTGCCTAATGAGTGAGCTAACTCACATTAATTGCGTTGCGCTC
ACTGCCCGCTTTCCAGTCGGGAAACCTGTCGTGCCAGCTGCATTAATGAAT
CGGCCAACGCGCGGGGAGAGGCGGTTTGCGTATTGGGCGCCAGATACCGG
CCTCCATCGGAGAAACTGTCCGAGGTTATGTTGACCTGCAGGGGGGGGGG
GGCCCCTGAGGTCTGCCTCGNGAAGAAGGGGTTGCTGACTC

Nt 77-200 of SEQ ID NO: 606 corresponds to compliment of nt 1-124 of the *ihfB* gene.
Nt 77-236 of SEQ ID NO: 606 corresponds to compliment of nt 1455-1614 of the contig 408 (SEQ ID NO: 408).

Figure 3J

SEQ ID NO: 607

NACAGNNTTGGGACAACTCCAGTGAAAAGTTCTTCTCCTTTACTCATATGT
ATATCTCCTTCTTAAATCTAGAGGATCAACATCTAAGACAAGATTTTTAA
TGGACTACTGGTATTGGGAACACTTAATTCATTTGGTAAGCAATAGACCAT
TTCCATTTTTGTATTACGAGTGCGAACCGCACCAAATTTGCTGAGCATTCT
CGATATTTTTGATTGATTAATACCAGTAAAGCCTTGTTTTTTAAGGCATC
GACAATTTCATTTTGAGAACCAAAGCGTTCTTGATTGAGTAATTCTTTAAA
AGCACGAGTTAAATTGTCAGTCATCTTTATTTTTAATAGTCAAAATTTGC
ATAAGAATTGCATAAAAATTNNNCTTTCATCAACTGGAATATGGNTTNGN
ACCNNGGGGAAGAAATTTTTTNNNNAAAATGGAACNAGATCCNTTNAA
GNCAACCTGCAGGCATGCAAGCTNGGCGNAATCANGGCATAGCTGNTTCC
TGGGNAAATTGNTATCCGTTANAATTCCCNCNACATNCNANCCGNAGCAT
AAGNGAAAGCCTGGGGGCNTANGANGNGGCTACCCCCATNATT

Nt 75-330 of SEQ ID NO: 607 corresponds to compliment of nt 1-256 of the *argR* gene.
Corresponding sequence not found in contig set.

SEQ ID NO: 608

TTTAACAAGGAATCCGGGCACAACTACCAGTGAAAAGTTCTCTCTCCTTTA
CTCATATGTATATCTCCTTCTTAAATCTAGAGGATCCTTTATCGCTGTGGA
GAACTTCAAATTGTACTTTTGACCTGCTTTTAATGAACGATAGCCGTCCA
TTTCAATCACTGAATAATGTGCAAAATATCGGCATCTACACCTTCTGCGG
AAATGAAACCAAATCCTTTTGCATTATTGAACCATTTTACAATACCAATTT
CCATAAAAGACCTCTCTAGGCTTAGCCTATTAAAACAATAAATCAACAAG
ACTCTCGCCTTATCACCTACTAATTAGGTCCGTTATGTTTAAATATTTTGAA
CGGTTATGCAACGAGCAATATTCAAAAATGATAAGTAGATCCTCTAGAGT
CGACCTGCAGGCATGCAAGCTTGGCGTAATCATGGTCATAGCTGTTNCCT
GNGTGAAATTGTTATCCGCTCACAATTCCACACAACATACGAGCCGGAAG
CATAAAGTGNTAAGCNTGGGGTGCCTAATGAGTGNNCTAACTNACATAAA
TTGAGTTANGCTCACTGCNCCGTTTTCCAGNNGGNGANACCNG

Nt 84-259 of SEQ ID NO: 608 corresponds to compliment of nt 1-176 of the *ihfB* gene.
Corresponding sequence not found in contig set.

Figure 3K

SEQ ID NO: 609

TAACAGCATTGGGACAACTCCAGTGAAAAGTTCTTCTCCTTTACTCATATG
TATATCTCCTTCTTAAATCTAGAGGATCTATTACAGAACCATCATTTCCCC
AAATCAAGAATAGCTTTGATGAAAATAAGTAAAATCGGTAAGACAATAG
GAATACTCACGACATAGCCCGTAATGGCTAATGCCCATTCTTCCTTTTCT
TACCTAGAAATTTGATAAAACTGAACGCCATTTTTTCAGCAACTGGGCAG
ATTGAAGTTTCACCATGTAAAGGTTCTCGAATAATGCTACTTACAAAGGA
AGAAGTCGCTTTATTTGGTTTTCCTGGACGGATACAAATTGTGAGCAGGCG
AACACAGAGACCATCAACAAAACCTTTTCTTGTATAGTCATTAATAAGTA
ATTCACTCATTGCTTTTGTGCACCATAAGTCGATTGTGGCGTTACAGCAG
TAGAATCCTGAATAATTTCTGGTAAATCACCACCAAATACAGCAAGTGAA
CTAGAAAAAATAAAACGAATTTTAGTATCAGATTCATCAAAATATGAGAA
AGTGGCGACATTCCATATTTGTCCACTAACAAATTTTGATCCTCTA

Nt 93-413 of SEQ ID NO: 609 corresponds to compliment of nt 1-321 of the HI0094 gene.
Nt 76-595 of SEQ ID NO: 609 corresponds to nt 1467-1985 of the contig 379 (SEQ ID NO: 379).

SEQ ID NO: 610

TTNNACAAGNAATTGGGACAACTCCAGTGAAAAGTTCTTCTCCTTTACTCA
TATGTATATCTCCTTCTTAAATCTAGAGGATCATCAAGATAATCAAGTACA
TATTGTTCAATTTGAGGAATGCGATTTAGACTTGGCAACATAGTATTTAAC
TCATTTAAAGGTAAAAATGGCAGGTTATTGATAATATCTTAAGGCGTTAAT
GATGTCGAATTAGATTTTGAGCATTTTAAGGAGTGTTTTATGGAGTAAAT
GAGTCAAGAAAAGTGTGTTGTTTGGATGAAAAATAAACNAAAAATTCAAA
AGAATTTGATCCTCTAGAGTCGACCTGCAGGCATGCAAGCTTGGCGTAAT
CATGGTCATAGCTGNTTCCTGTGTGAAATTGNTATCCGCTCACAATTCCAC
ACAACATACGAGCCGGAAGCATAAAGTGTAAAGCCTGGGGTGCCTAATG
AGTGAGCTAACTCACATTAATTGCGNNGCGCTCNCTNNCCCCTTTNCNCA
GGGGAAAACCCTGNCGCNCCAGCTGCNTTTAATGAATCNGCCCNCNGCG
GGGAGGGGCNGNTTGCGTNTTGGGCGCCANANCCCGNCTCCATCG

Nt 80-143 of SEQ ID NO: 610 corresponds to compliment of nt 1-64 of the HI1163 gene.
Nt 80-316 of SEQ ID NO: 610 corresponds to compliment of nt 117-353 of the contig 513 (SEQ ID NO: 513).

Figure 3L

SEQ ID NO: 611

NACAAGNAATTGGGACAACTCCAGTGAAAAGTTCTTCTCCTTTACTCATAT
GTATATCTCCTTCTTAAATCTAGAGGATCGTCATCTTTACGATATTTTTCAT
CAATTCGTTTTTGCAATCCAAAGTCATTTTTATCCGATTCGTTAGAAAATA
AATCTTCTGTTTGCGTTAATTGAGGATTTTGAATTCCTATCCAATTTGCAAT
CCCTTCTAAGAAATTTAAACCTGATTTAAACACCTTATATTCTTTGCGTTCC
ATATCATCTGATGAAATTTTGAATAGCGGAATATTATGGTGCTCTCGGCTG
AAACAGTTTTGATTGAACAAAAGTATATTGTTTTTTTCATCTTGTTGGTGG
CACAAACCGTGATCCTCTAGAGTCGACCTGCAGGCATGCAAGCTTGGCGT
AATCATGGTCATAGCTGTTTCCTGTGTGAAATTGTTATCCGCTCACAATTC
CACACAACATACGAGCCGGAAGCATAAAGTGTAAAGCCTGGGGTGCCTA
ATGAGTGAGCTAACTCACATTAATTGCGTTGCGCTCACTGCCCGNTTTCCA
GTCGGGAAANCCTGTCGTGCCAGCTGCATTAATGAATCG

Nt 76-260 of SEQ ID NO: 611 corresponds to compliment of nt 1-185 of the gene HI1063.
Nt 76-374 of SEQ ID NO: 611 corresponds to nt 229-527 of the contig 48 (SEQ ID NO: 48).

SEQ ID NO: 612

ATTNNACAAGNAATTGGGCACAACTCCAGTGAAAAGTTCTTCTCCTTTACT
CATATGTATATCTCCTTCTTAAATCTAGAGGATCATCTTTGATAATAAGCT
GTAATTTTGGTTGAAAACCTGAAATGCTCATCCCTTGCTGTTTTTGGGGTT
TCACTGTAATAAATTCTTGGCGAGAAAAGGGCAATTCAGGATTAAAATGT
TTATTGCCTGTAAGATAGTGTAAACCTTTTGTGCTGTAACCAGAATGAACT
TCATTTTTTTTCAATGGCTTTAATAAAATACGACAAAAATTCATTGTTTTTC
TTCCTGAATTTGCACTGCGCCTAACATATTTTCCCCGTTATTAAGTAAAAA
GCGAAACATATCGCTTTCATCAATTCGTTGATGAAGTGCATATTTGTGTTT
TAGCCAGCCTTCTGGGACGAGGGATGCAAAATAAGGGAATAAGGTGTNA
GAATGAAAAGGACTTTGCTCAATAGGAAAGCTGAGAGAGAGCGGTATTCC
TTGATAATCGGGATTGTAAGCAAAATGAAAACCTCGATGATCCTCTAGAG
TCGACCTGCAGGCATGCAAGCTTGGCGTAATCATGGTCATAGC

Nt 84-298 of SEQ ID NO: 612 corresponds to compliment of nt 1-215 of the HI0665 gene.
Nt 82-549 of SEQ ID NO: 612 corresponds to compliment of nt 4726-5193 of the contig 557 (SEQ ID NO: 557).

Figure 3M

SEQ ID NO: 613

NACAGNATTGGGACAACTCCAGTGAAAAGTTCTTCTCCTTTACTCATATGT
ATATCTCCTTCTTAAATCTAGAGGATCACTGCATTGAGTAAACGACTTTGT
GATTCAATATTATTTTCGAGTGCAGTCAGGCGAAAATAGGTTTCGATTAAA
TACATAAATTTTTTAATTGCTGTCTGATTTGGTTTAAGCCGTTTAAACGCAT
TTCACTTAAACGTTGTGAAATGCCGAGTTCGCTAAAAAAGGCAATAATAT
CAAATGTATTCAATTCATCCGCTGTTTTGCCATTGATTTGATTGAATAAAA
TCCAAAGCAAGCCATTCATAATTCTGGCTTCGCTAAATCCGCTGAATTGAA
AAGTGCGGTCATGTTTAGGCATAATTTGAAACCACATTTGTGCTTCGCAGC
CAGNNAATAGGTTGCATTTGAGCGAGTTCATTATCGCTTGGGCGAGGNNA
ANNTTTTGNCTNCNCNGGAAAAATCAGGNNATNGCGATCCTTTAGAGTCG
ACCTGCAGGCATGCAAGCTTGGCNGTAATCATGGNCATAGCTGNTTCCTG
GGGGAAATNGTTNTCCGNTNCAATTCCCCACAACATACGAGC

Nt 75-158 of SEQ ID NO: 613 corresponds to compliment of nt 1-84 of the HI1292
gene.
Nt 142-455 of SEQ ID NO: 613 corresponds to nt 12-324 of the contig 313 (SEQ ID
NO: 313).

SEQ ID NO: 614

CAAGACTTGGGACAACTCCAGTGAAAAGTTCTTCTCCTTTACTCATATGTA
TATCTCCTTCTTAAATCTAGAGGATCTACAGTTGGTTCTGTAAACATCCCA
GAACCGATTAAAATAAAATAACCCGCGAATGCGGCACAAATCACCGCAA
AAAGTGCGGGCAAAATTTGGCTTGTTTTTTTCGTGTTCATCATTGTCTTCCC
TGAAAAGAAAATATCGCTATTATCCACCTTTCACTCAGAATTTCCATATTT
AACTTCTTCACTCTTGAGCGGTTATTTTATAGAATAAGCCAATTTTTTTAA
GCCAGAAGGAAAAAACAATGAGCCAACCAATTTATAAACGTATTTTATTG
AAATTAAGCGGTGAAGCATTACAAGGAGAAGATGGTCTTGGTATCGATCC
TCTAGAGTCGACCTGCAGGCATGCAAGCTTGGCGTAATCATGGTCATAGC
TGTTTCCTGTGTGAATTGTTATCCGCTCACAATTCCACACAACATACGAG
CCGGAAGCATAAAGTGTAAAGCCTGGGGTGCCTAATGAGTGAGCTAACTC
ACATTAATTGCGTTGCGCTCACTGCCCGCTTTCCAGTCGGGAAA

Nt 83-265 of SEQ ID NO: 614 corresponds to compliment of nt 1-181 of the HI1064
gene.
Nt 74-406 of SEQ ID NO: 614 corresponds to nt 440-772 of the contig 178 (SEQ ID
NO: 178).

GENES OF AN OTITIS MEDIA ISOLATE OF NONTYPEABLE *HAEMOPHILUS INFLUENZAE*

RELATED APPLICATIONS

The present application is a continuation of U.S. application Ser. No. 10/795,159, filed Mar. 5, 2004, now U.S. Pat. No. 7,241,867, which claims priority benefit from U.S. Provisional Application 60/453,134 filed Mar. 6, 2003 which is incorporated herein by reference in its entirety.

FIELD OF INVENTION

The invention relates to the polynucleotide sequence of a nontypeable strain of *Haemophilus influenzae* (NTHi) genome, NTHi genes contained within the genome and polypeptides encoded by the polynucleotides. The invention also relates to uses of these NTHi polynucleotides and NTHi polypeptides including vaccines and methods of treating and preventing NTHi related disorders. The invention also relates to NTHi genes which are upregulated during or in response to NTHi infection of the middle ear or nasopharynx.

BACKGROUND

Otitis media (OM) is a highly prevalent pediatric disease worldwide and is the primary cause for emergency room visits by children (Infante-Rivand and Fernandez, *Epidemiol. Rev.*, 15: 444-465, 1993). Recent statistic indicate that 24.5 million physician office visits were made for OM in 1990, representing a greater than 200% increase over those reported in the 1980's. While rarely associated with mortality any longer, the morbidity associated with OM is significant. Hearing loss is a common problem associated with this disease, often times affecting a child's behavior, education and development of language skills (Baldwin, *Am. J. Otol.*, 14: 601-604, 1993; Hunter et al., *Ann. Otol. Rhinol. Laryngol. Suppl.*, 163: 59-61, 1994; Teele et al., *J. Infect. Dis.*, 162: 685-694, 1990). The socioeconomic impact of OM is also great, with direct and indirect costs of diagnosing and managing OM exceeding $5 billion annually in the U.S. alone (Kaplan et al., *Pediatr. Infect. Dis. J.*, 16: S9-11, 1997).

Whereas antibiotic therapy is common and the surgical placement of tympanostomy tubes has been successful in terms of draining effusions, clearing infection and relieving pain associated with the accumulation of fluids in the middle ear, the emergence of multiple antibiotic-resistant bacteria and the invasive nature associated with tube placement, has illuminated the need for more effective and accepted approaches to the management and preferably, the prevention of OM. Surgical management of chronic OM involves the insertion of tympanostomy tubes through the tympanic membrane while a child is under general anesthesia. While this procedure is commonplace (prevalence rates are ~13%; Bright et al., *Am. J. Public Health*, 83(7): 1026-8, 1993) and is highly effective in terms of relieving painful symptoms by draining the middle ear of accumulated fluids, it too has met with criticism due to the invasive nature of the procedure and its incumbent risks (Berman et al., *Pediatrics*, 93(3):353-63, 1994; Bright et al., supra.; Cimons, *ASM News*, 60: 527-528; Paap, *Ann. Pharmacother.*, 30(11): 1291-7, 1996).

Progress in vaccine development is most advanced for *Streptococcus pneumoniae*, the primary causative agent of acute OM (AOM), as evidenced by the recent approval and release of a seven-valent capsular-conjugate vaccine, PREVNAR® (Eskola and Kilpi, *Pediatr. Infect. Dis. J.* 16: S72-78, 2000). While PREVNAR® has been highly efficacious for invasive pneumococcal disease, coverage for OM has been disappointing (6-8%) with reports of an increased number of OM cases due to serotypes not included in the vaccine (Black et al., *Pedriatr. Infect. Dis J.*, 19: 187-195; Eskola et al., *Pedriatr. Infect. Dis. J.*, 19: S72-78, 2000; Eskola et al., *N. Engl. J. Med.* 344: 403-409, 2001; Snow et al., *Otol. Neurotol.*, 23: 1-2, 2002). Less progress has been made for nontypeable *Haemophilus influenzae* (NTHi), the gram-negative pathogen that predominates in chronic OM with effusion (Klein, *Pedriatr. Infect. Dis. J.*, 16: S5-8, 1997; Spinola et al., *J. Infect. Dis.*, 154: 100-109, 1986). Hampering development of effective vaccines against NTHi, is the currently incomplete understanding of the pathogenesis of NTHi-induced middle ear disease. Contributing to this delay is a lack of understanding of the dynamic interplay between microbe-expressed virulence factors and the host's immune response as the disease progresses from one of host immunological tolerance of a benign nasopharyngeal commensal, to that of an active defensive reaction to an opportunistic invader of the normally sterile middle ear space.

Currently there is a poor understanding of how NTHi causes OM in children. The identification of putative virulence factors necessary for induction of OM will contribute significantly to the understanding of the host-pathogen interaction and ultimately, the identification of potential vaccine candidates and targets of chemotherapy. There is a tremendous need to develop more effective and accepted approaches to the management and preferably, the prevention of otitis media. Vaccine development is a very promising and cost effective method to accomplish this goal (Giebank, *Pedriatr. Infect. Dis. J.*, 13(11): 1064-8, 1994: Karma et al., *Int. J. Pediatr. Otorhinolaryngol.*, 32(Suppl.): S127-34, 1995).

SUMMARY OF INVENTION

The present invention provides for the identification and characterization of the genomic sequence of NTHi *H. influenzae* strain 86-028NP and the polypeptide sequences encoded thereby. The 3-fold analysis of the NTHi genomic sequence is set out in a series of contig sequences denoted as SEQ ID NO: 1-576, and the subsequent 8-fold analysis of the genomic sequence is set out in a series of 11 contig sequences denoted as SEQ ID NOS: 675-685. These contigs are raw data and one of skill in the art may assemble these contigs by comparing overlapping sequences to construct the complete genome of the NTHi stain 86-028NP using routine methods.

The present invention also provides for antibodies specific for the NTHi polypeptides of the invention. Methods of detecting NTHi bacteria in a human or in sample, such as serum, sputum, ear fluid, blood, urine, lymphatic fluid and cerebrospinal fluid are contemplated. These methods include detecting NTHi polynucleotides with specific polynucleotide probes or detecting NTHi polypeptides with specific antibodies. The invention also contemplates diagnostic kits which utilize these methods of detecting NTHi bacteria.

The present invention also contemplates methods of eliciting an immune response by administering a NTHi polypeptide of the invention or a NTHi peptide thereof. These methods include administering the NTHi polypeptide or NTHi peptide as a vaccine for treatment and/or prevention of diseases caused by NTHi infection, such as OM. The following NTHi genes are upregulated during or in response to middle ear and/or nasopharynx infections; and the polypeptides encoded by these genes and peptides thereof are contemplates as possible OM vaccine candidates and/or target of chemotherapy: hisB, lppB, sapA, lolA, rbsC, purE, ribB, arcB, uxuA, dsbB, ureH, licC, HI1647, ispZ, radC, mukF, glpR, ihfB, argR, cspD, HI0094, HI1163, HI1063, HI0665, HI1292, HI1064. NTHi hisB gene is set out as nucleotide sequence SEQ ID NO: 615 and encodes the amino acid sequence set out as SEQ ID NO: 616. NTHi sapA gene is set out as nucleotide sequence SEQ ID NO: 617 and encodes the amino acid sequence set out as SEQ ID NO: 618. NTHi rbsC gene is set out as nucleotide sequence SEQ ID NO: 619 and encodes the amino acid sequence set out as SEQ ID NO: 620. NTHi purE gene is set out as nucleotide sequence SEQ ID NO: 621 and encodes the amino acid sequence set out as SEQ ID NO: 622. NTHi ribB gene is set out as nucleotide sequence SEQ ID NO: 623 and encodes the amino acid sequence set out as SEQ ID NO: 624. NTHi arcB gene is set out as nucleotide sequence SEQ ID NO: 625 and encodes the amino acid sequence set out as SEQ ID NO: 626. NTHi uxuA gene is set out as nucleotide sequence SEQ ID NO: 627 and encodes the amino acid sequence set out as SEQ ID NO: 628. NTHi dsbB gene is set out as nucleotide sequence SEQ ID NO: 629 and encodes the amino acid sequence set out as SEQ ID NO: 630. NTHi ureH gene is set out as nucleotide sequence SEQ ID NO: 631 and encodes the amino acid sequence set out as SEQ ID NO: 632. NTHi licC gene is set out as nucleotide sequence SEQ ID NO: 633 and encodes the amino acid sequence set out as SEQ ID NO: 634. NTHi HI1647 gene is set out as nucleotide sequence SEQ ID NO: 635 and encodes the amino acid sequence set out as SEQ ID NO: 636. NTHi ispZ gene is set out as nucleotide sequence SEQ ID NO: 637 and encodes the amino acid sequence set out as SEQ ID NO: 638. NTHi radC gene is set out as nucleotide sequence SEQ ID NO: 639 and encodes the amino acid sequence set out as SEQ ID NO: 640. NTHi mukF gene is set out as nucleotide sequence SEQ ID NO: 641 and encodes the amino acid sequence set out as SEQ ID NO: 642. NTHi glpR gene is set out as nucleotide sequence SEQ ID NO: 643 and encodes the amino acid sequence set out as SEQ ID NO: 644. NTHi ihfB gene is set out as nucleotide sequence SEQ ID NO: 645 and encodes the amino acid sequence set out as SEQ ID NO: 646. NTHi argR gene is set out as nucleotide sequence SEQ ID NO: 647 and encodes the amino acid sequence set out as SEQ ID NO: 648. NTHi cspD gene is set out as nucleotide sequence SEQ ID NO: 649 and encodes the amino acid sequence set out as SEQ ID NO: 650. NTHi HI1163 gene is set out as nucleotide sequence SEQ ID NO: 651 and encodes the amino acid sequence set out as SEQ ID NO: 652. NTHi HI1063 gene is set out as nucleotide sequence SEQ ID NO: 653 and encodes the amino acid sequence set out as SEQ ID NO: 654. NTHi HI0665 gene is set out as nucleotide sequence SEQ ID NO: 655 and encodes the amino acid sequence set out as SEQ ID NO: 656. NTHi HI1292 gene is set out as nucleotide sequence SEQ ID NO: 657 and encodes the amino acid sequence set out as SEQ ID NO: 658.

The novel NTHi genes included in the polynucleotide sequences presented as SEQ ID NOS: 1-576, SEQ ID NOS: 675-685 and the nucleotide sequences set out in Tables 4 and 4B are also up-regulated during infection of the middle ear and/or the nasopharynx, and therefore are contemplated to encode OM vaccine candidates and/or targets of chemotherapy. In addition, the following NTHi genes are contemplated to be virulence-associated genes and therefore are contemplated to encode possible OM vaccine candidates and/or targets of chemotherapy: HI1386, HI1462, HI1369, lav, HI1598. NTHi HI1386 gene sequence is set out as SEQ ID NO: 659 and encodes the amino acid sequence set out as SEQ ID NO: 660. NTHi HI1462 gene sequence is set out as SEQ ID NO: 661 and encodes the amino acid sequence set out as SEQ ID NO: 662. NTHi HI1369 gene sequence is set out as SEQ ID NO: 665 and encodes the amino acid sequence set out as SEQ ID NO: 666. NTHi lav gene sequence is set out as SEQ ID NO: 663 and encodes the amino acid sequence set out as SEQ ID NO: 664. NTHi HI1598 gene sequence is set out as SEQ ID NO: 669 and SEQ ID NO: 671 and encodes the amino acid sequence set out as SEQ ID NO: 670 and SEQ ID NO: 672. Additional NTHi genes associated with virulence include the polynucleotide sequences presented as SEQ ID NO: 667 and SEQ ID NO: 673.

As a method of treating or preventing NTHi infection, the present invention contemplates administering a molecule that inhibits expression or the activity of the NTHi polypeptides, which are upregulated or active during infection. In particular, the invention contemplates methods of treating or preventing NTHi infection comprising modulating NTHi protein expression by administering an antisense oligonucleotide that specifically binds to NTHi genes that are upregulated during NTHi infections, such genes include hisB, lppB, sapA, lolA, rbsC, purE, ribB, arcB, uxuA, dsbB, ureH, licC, HI1647, ispZ, radC, mukF, glpR, ihfB, argR, cspD, HI0094, HI1163, HI1063, HI0665, HI1292, HI1064. The invention also contemplates methods of treating or preventing NTHi infection comprising administering antibodies or small molecules that modulate the activity of the proteins encoded by theses genes. The novel NTHi genes included in the polynucleotide sequences presented as SEQ ID NOS: 1-576, SEQ ID NOS: 675-685 and the nucleotide sequences set out in Tables 4 and 4B are also up-regulated during infection of the middle ear and/or the nasopharynx and therefore antisense oligonucleotides that specifically bind these polynucleotide sequences are also contemplated.

Polynucleotides and Polypeptides of the Invention

The present invention provides for the sequences of the NTHi strain 86-028NP genome. This genomic sequence is presented as a series of contig sequences denoted herein as "contigs 1-576". Each contig is assigned a sequence identification number that correlates with its "contig number". Therefore, the contigs of the present invention as set out as SEQ ID NOS: 1-576. These contig polynucleotide sequences may be assembled into the complete genome sequence of the NTHi strain 86-028NP using routine methods. Upon completion of 8-fold sequence analysis of the NTHi strain 82-028NP genome, the genomic sequence was assembled into 11 contigs which are denoted herein as SEQ ID NOS: 675-685.

The present invention provides for the NTHi polynucleotide sequences and open reading frames contained within the contigs of SEQ ID NOS: 1-576, SEQ ID NOS: 675-685 and the nucleotide sequences set out in Table 3B, Table 4B and Table 5. The present invention also provides for the polypeptide sequences encoded by the NTHi polynucleotides of the present invention such as the amino acid sequences set out in Table 3B, Table 4B and Table 5. The invention provides for polynucleotides that hybridize under stringent conditions to (a) the complement of the nucleotides sequence of SEQ ID NOS: 1-576; SEQ ID NOS: 675-685 and the nucleotide sequences set out in Table 3B, Table 4B and Table 5 herein (b) a polynucleotide which is an allelic variant of any polynucleotides recited above; (c) a polynucleotide which encodes a species homolog of any of the proteins recited above; or (d) a polynucleotide that encodes a polypeptide comprising a specific domain or truncation of the NTHi polypeptides of the present invention.

The NTHi polynucleotides of the invention also include nucleotide sequences that are substantially equivalent to the polynucleotides recited above. Polynucleotides according to the invention can have, e.g., at least 65%, at least 70%, at least 75%, at least 80%, 81%, 82%, 83%, 84%, 85%, 86%, 87%, 88%, or 89%, more typically at least 90%, 91%, 92%, 93%, or 94% and even more typically at least 95%, 96%, 97%, 98% or 99% sequence identity to the NTHi polynucleotides recited above.

Included within the scope of the nucleic acid sequences of the invention are nucleic acid sequence fragments that hybridize under stringent conditions to the NTHi nucleotide sequences of SEQ ID NOS: 1-576, SEQ ID NOS: 675-685 and the nucleotide sequences set out in Table 3B, Table 4B and Table 5 herein, or compliments thereof, which fragment is greater than about 5 nucleotides, preferably 7 nucleotides, more preferably greater than 9 nucleotides and most preferably greater than 17 nucleotides. Fragments of, e.g., 15, 17, or 20 nucleotides or more that are selective for (i.e., specifically hybridize to any one of the polynucleotides of the invention) are contemplated. Probes capable of specifically hybridizing to a polynucleotide can differentiate NTHi polynucleotide sequences of the invention from other polynucleotide sequences in the same family of genes or can differentiate NTHi genes from other bacterial genes, and are preferably based on unique nucleotide sequences.

The term "stringent" is used to refer to conditions that are commonly understood in the art as stringent. Hybridization stringency is principally determined by temperature, ionic strength, and the concentration of denaturing agents such as formamide. Examples of stringent conditions for hybridization and washing are 0.015 M sodium chloride, 0.0015 M sodium citrate at 65-68° C. or 0.015 M sodium chloride, 0.0015M sodium citrate, and 50% formamide at 42° C. See Sambrook et al., *Molecular Cloning: A Laboratory Manual*, 2$^{nd}$ Ed., Cold Spring Harbor Laboratory, (Cold Spring Harbor, N.Y. 1989). More stringent conditions (such as higher temperature, lower ionic strength, higher formamide, or other denaturing agent) may also be used, however, the rate of hybridization will be affected. In instances wherein hybridization of deoxyoligonucleotides is concerned, additional exemplary stringent hybridization conditions include washing in 6×SSC 0.05% sodium pyrophosphate at 37° C. (for 14-base oligos), 48° C. (for 17-base oligos), 55° C. (for 20-base oligos), and 60° C. (for 23-base oligos).

Other agents may be included in the hybridization and washing buffers for the purpose of reducing non-specific and/or background hybridization. Examples are 0.1% bovine serum albumin, 0.1% polyvinyl-pyrrolidone, 0.1% sodium pyrophosphate, 0.1% sodium dodecylsulfate, $NaDodSO_4$, (SDS), ficoll, Denhardt's solution, sonicated salmon sperm DNA (or other non-complementary DNA), and dextran sulfate, although other suitable agents can also be used. The concentration and types of these additives can be changed without substantially affecting the stringency of the hybridization conditions. Hybridization experiments are usually carried out at pH 6.8-7.4, however, at typical ionic strength conditions, the rate of hybridization is nearly independent of pH. See Anderson et al., *Nucleic Acid Hybridisation: A Practical Approach*, Ch. 4, IRL Press Limited (Oxford, England). Hybridization conditions can be adjusted by one skilled in the art in order to accommodate these variables and allow DNAs of different sequence relatedness to form hybrids.

The sequences falling within the scope of the present invention are not limited to these specific sequences, but also include allelic and species variations thereof. Allelic and species variations can be routinely determined by comparing the sequence provided in SEQ ID NOS: 1-576, SEQ ID NOS: 675-685, and nucleotide sequences out in Table 3B, Table 4B and Table 5 herein, preferably the open reading frames therein, a representative fragment thereof, or a nucleotide sequence at least 90% identical, preferably 95% identical, to the open reading frames within SEQ ID NOS: 1-576, SEQ ID NOS: 675-685 and the nucleotide sequences set out in Table 3B, Table 4B and Table 5 with a sequence from another isolate of the same species. Preferred computer program methods to determine identity and similarity between two sequences include, but are not limited to, the GCG program package, including GAP (Devereux et al., *Nucl. Acid. Res.*, 12: 387, 1984; Genetics Computer Group, University of Wisconsin, Madison, Wis.), BLASTP, BLASTN, and FASTA (Altschul et al., *J. Mol. Biol.*, 215: 403-410, 1990). The BLASTX program is publicly available from the National Center for Biotechnology Information (NCBI) and other sources (BLAST Manual, Altschul et al. NCB/NLM/NIH Bethesda, Md. 20894; Altschul et al., supra). The well known Smith Waterman algorithm may also be used to determine identity.

Furthermore, to accommodate codon variability, the invention includes nucleic acid molecules coding for the same amino acid sequences as do the specific open reading frames (ORF) disclosed herein. In other words, in the coding region of an ORF, substitution of one codon for another codon that encodes the same amino acid is expressly contemplated.

The isolated polypeptides of the invention include, but are not limited to, a polypeptide comprising: the amino acid sequences encoded by the nucleotide sequences included within the polynucleotide sequences set out as SEQ ID NOS: 1-576, SEQ ID NOS: 675-685 and the nucleotide sequences set out in Table 3B, Table 4B and Table 5, or the corresponding full length or mature protein. The polypeptides of the invention include the amino acid sequences of SEQ ID NO: 616, SEQ ID NO: 618, SEQ ID NO: 620, SEQ ID NO: 622, SEQ ID NO: 624, SEQ ID NO: 626, SEQ ID NO: 628, SEQ ID NO: 628, SEQ ID NO: 630, SEQ ID NO: 632, SEQ ID NO: 634, SEQ ID NO: 636, SEQ ID NO: 638, SEQ ID NO: 640, SEQ ID NO: 642, SEQ ID NO: 644, SEQ ID NO: 646, SEQ ID NO: 648, SEQ ID NO: 650, SEQ ID NO: 652, SEQ ID NO: 654, SEQ ID NO: 656, SEQ ID NO: 658, SEQ ID NO: 660, SEQ ID NO: 662, SEQ ID NO: 664, SEQ ID NO: 666, SEQ ID NO: 668, SEQ ID NO: 670, SEQ ID NO: 672, SEQ ID NO: 674, SEQ ID NO: 687, SEQ ID NO: 689, SEQ ID NO: 691, SEQ ID NO: 693, SEQ ID NO: 695, SEQ ID NO: 697, SEQ ID NO: 699, SEQ ID NO: 701, SEQ ID NO: 703, SEQ ID NO: 705, SEQ ID NO: 707, SEQ ID NO: 709, SEQ ID NO: 711, SEQ ID NO: 713, SEQ ID NO:715, SEQ ID NO: 717, SEQ ID NO: 719, SEQ ID NO: 721, SEQ ID NO:723, SEQ ID NO:725, SEQ ID NO:727, SEQ ID NO:729, SEQ ID NO: 731, SEQ ID NO: 733, SEQ ID NO: 735, SEQ ID NO: 737, SEQ ID NO: 739, SEQ ID NO: 741, SEQ ID NO: 743, SEQ ID NO: 745, SEQ ID NO: 747, SEQ ID NO: 749, SEQ ID NO: 751, SEQ ID NO: 753, SEQ ID NO: 755, SEQ ID NO: 757, SEQ ID NO: 759, SEQ ID NO: 761, 763, SEQ ID NO: 765, SEQ ID NO: 767, SEQ ID NO: 769 or SEQ ID NO: 771 which are set out in Table 3B, Table 4B and Table 5 herein.

Polypeptides of the invention also include polypeptides preferably with biological or immunogenic activity that are encoded by: (a) an open reading frame contained within the nucleotide sequences set forth as SEQ ID NOS: 1-576, SEQ ID NOS: 675-685 and the nucleotide sequences set out in Table 3B, Table 4B and Table 5, or (b) polynucleotides that hybridize to the complement of the polynucleotides of (a) under stringent hybridization conditions.

The invention also provides biologically active or immunologically active variants of the amino acid sequences of the present invention; and "substantial equivalents" thereof (e.g., with at least about 65%, at least about 70%, at least about 75%, at least about 80%, at least about 85%, 86%, 87%, 88%, 89%, at least about 90%, 91%, 92%, 93%, 94%, typically at least about 95%, 96%, 97%, more typically at least about 98%, or most typically at least about 99% amino acid identity) that retain biological and/or immunogenic activity. Polypeptides encoded by allelic variants may have a similar, increased, or decreased activity compared to polypeptides encoded by the polynucleotides included within the nucleotide sequences presented in SEQ ID NOS: 1-576, SEQ ID NOS: 675-685 and the nucleotide sequences set out in Table 3B, Table 4B and Table 5 herein, and the polypeptides having an amino acid sequence set out in Table 3B, Table 4B and Table 5 herein NTHi peptides refer to fragments of the NTHi polypeptides encoded by the nucleotide sequences presented in SEQ ID NOS: 1-576, SEQ ID NOS: 675-685 or the nucleotide sequences set out in Table 3B, Table 4B and Table 5 herein, and the polypeptides having the amino acid sequences set out in Table 3B, Table 4B and Table 5 herein. The preferred NTHi peptides are biologically and/or immunologically active.

The present invention further provides isolated NTHi polypeptides or NTHi peptides encoded by the NTHi nucleic acid fragments of the present invention or by degenerate variants of the nucleic acid fragments of the present invention. The term "degenerate variant" refers to nucleotide fragments which differ from a nucleic acid fragment of the present invention (e.g., an ORF) by nucleotide sequence but, due to the degeneracy of the genetic code, encode an identical NTHi polypeptide sequence. Preferred nucleic acid fragments of the present invention are the ORFs that encode proteins.

The invention also provides for NTHi polypeptides with one or more conservative amino acid substitutions that do not affect the biological and/or immunogenic activity of the polypeptide. Alternatively, the NTHi polypeptides of the invention are contemplated to have conservative amino acids substitutions which may or may not alter biological activity. The term "conservative amino acid substitution" refers to a substitution of a native amino acid residue with a nonnative residue, including naturally occurring and nonnaturally occurring amino acids, such that there is little or no effect on the polarity or charge of the amino acid residue at that position. For example, a conservative substitution results from the replacement of a non-polar residue in a polypeptide with any other non-polar residue. Further, any native residue in the polypeptide may also be substituted with alanine, according to the methods of "alanine scanning mutagenesis". Naturally occurring amino acids are characterized based on their side chains as follows: basic: arginine, lysine, histidine; acidic: glutamic acid, aspartic acid; uncharged polar: glutamine, asparagine, serine, threonine, tyrosine; and non-polar: phenylalanine, tryptophan, cysteine, glycine, alanine, valine, proline, methionine, leucine, norleucine, isoleucine. General rules for amino acid substitutions are set forth in Table 1 below.

TABLE 1

Amino Acid Substitutions

| Original Residues | Exemplary Substitutions | Preferred Substitutions |
|---|---|---|
| Ala | Val, Leu, Ile | Val |
| Arg | Lys, Gln, Asn | Lys |
| Asn | Gln | Gln |
| Asp | Glu | Glu |
| Cys | Ser, Ala | Ser |
| Gln | Asn | Asn |
| Glu | Asp | Asn |

TABLE 1-continued

Amino Acid Substitutions

| Original Residues | Exemplary Substitutions | Preferred Substitutions |
|---|---|---|
| Gly | Pro, Ala | Ala |
| His | Asn, Gln, Lys, Arg | Arg |
| Ile | Leu, Val, Met, Ala, Phe, | Leu |
| Leu | Norleucine, Ile, Val, Met, | Leu |
| Lys | Arg, 1,4 Diaminobutyric | Arg |
| Met | Leu, Phe, Ile | Leu |
| Phe | Leu, Val, Ile, Ala, Tyr | Arg |
| Pro | Ala | Gly |
| Ser | Thr, Ala, Cys | Thr |
| Thr | Ser | Ser |
| Trp | Tyr, Phe | Tyr |
| Tyr | Trp, Phe, Thr, Ser | Phe |
| Val | Ile, Met, Leu, Phe, Ala, | Leu |

Antisense polynucleotides complementary to the polynucleotides encoding the NTHi polypeptides are also provided.

The invention contemplates that polynucleotides of the invention may be inserted in a vector for amplification or expression. For expression, the polynucleotides are operatively linked to appropriate expression control sequence such as a promoter and polyadenylation signal sequences. Further provided are cells comprising polynucleotides of the invention. Exemplary prokaryotic hosts include bacteria such as *E. coli, Bacillus, Streptomyces, Pseudomonas, Salmonella* and *Serratia*.

The term "isolated" refers to a substance removed from, and essentially free of, the other components of the environment in which it naturally exists. For example, a polypeptide is separated from other cellular proteins or a DNA is separated from other DNA flanking it in a genome in which it naturally occurs.

Antibodies and Methods for Eliciting an Immune Response

The invention provides antibodies which bind to antigenic epitopes unique to (i.e., are specific for) NTHi polypeptides. Also provided are antibodies which bind to antigenic epitopes common among multiple *H. influenzae* subtypes but unique with respect to any other antigenic epitopes. The antibodies may be polyclonal antibodies, monoclonal antibodies, antibody fragments which retain their ability to bind their unique epitope (e.g., Fv, Fab and F(ab)2 fragments), single chain antibodies and human or humanized antibodies. Antibodies may be generated by techniques standard in the art.

It is known in the art that antibodies to the capsular polysaccharide of *H. influenzae* exhibit the ability to kill bacteria in vitro assays. These antibodies are also known to protect against challenge with *H. influenzae* in animal model systems. These studies indicate antibody to the capsular polysaccharides are likely to elicit a protective immune response in humans. The present invention provides for antibodies specific for the NTHi polypeptides of the present invention and fragments thereof, which exhibit the ability to kill both *H. influenzae* bacteria and to protect humans from NTHi infection. The present invention also provides for antibodies specific for the NTHi polypeptides of the invention which reduce the virulence, inhibit adherence, inhibit cell division, and/or inhibit penetration into the epithelium of *H. influenzae* bacteria or enhance phagocytosis of the *H. influenzae* bacteria.

In vitro complement mediated bactericidal assay systems (Musher et al., *Infect. Immun.* 39: 297-304, 1983; Anderson et al., *J. Clin. Invest.* 51: 31-38, 1972) may be used to measure the bactericidal activity of anti-NTHi antibodies. Further data on the ability of NTHi polypeptides and NTHi peptides to elicit a protective antibody response may be generated by using animal models of infection such as the chinchilla model system described herein.

It is also possible to confer short-term protection to a host by passive immunotherapy via the administration of preformed antibody against an epitope of NTHi, such as antibodies against NTHi OMP, LOS or noncapsular proteins. Thus, the contemplated vaccine formulations can be used to produce antibodies for use in passive immunotherapy. Human immunoglobulin is preferred in human medicine because a heterologous immunoglobulin may provoke an immune response to its foreign immunogenic components. Such passive immunization could be used on an emergency basis for immediate protection of unimmunized individuals exposed to special risks. Alternatively, these antibodies can be used in the production of anti-idiotypic antibody, which in turn can be used as an antigen to stimulate an immune response against NTHi epitopes.

The invention contemplates methods of eliciting an immune response to NTHi in an individual. These methods include immune responses which kill the NTHi bacteria and immune responses which block *H. influenzae* attachment to cells. In one embodiment, the methods comprise a step of administering an immunogenic dose of a composition comprising a NTHi protein or NTHi peptide of the invention. In another embodiment, the methods comprise administering an immunogenic dose of a composition comprising a cell expressing a NTHi protein or NTHi peptide of the invention. In yet another embodiment, the methods comprise administering an immunogenic dose of a composition comprising a polynucleotide encoding a NTHi protein or NTHi peptide of the invention. The polynucleotide may be a naked polynucleotide not associated with any other nucleic acid or may be in a vector such as a plasmid or viral vector (e.g., adeno-associated virus vector or adenovirus vector). Administration of the compositions may be by routes standard in the art, for example, parenteral, intravenous, oral, buccal, nasal, pulmonary, rectal, or vaginal. The methods may be used in combination in a single individual. The methods may be used prior or subsequent to NTHi infection of an individual.

An "immunological dose" is a dose which is adequate to produce antibody and/or T cell immune response to protect said individual from NTHi infection, particularly NTHi infection of the middle ear and/or the nasopharynx or lower airway. Also provided are methods whereby such immunological response slows bacterial replication. A further aspect of the invention relates to an immunological composition which, when introduced into an individual capable or having induced within it an immunological response. The immunological response may be used therapeutically or prophylactically and may take the form of antibody immunity or cellular immunity such as that arising from CTL or CD4+ T cells. A NTHi protein or an antigenic peptide thereof may be fused with co-protein which may not by itself produce antibodies, but is capable of stabilizing the first protein and producing a fused protein which will have immunogenic and protective properties. Thus fused recombinant protein, preferably further comprises an antigenic co-protein, such as Glutathione-S-transferase (GST) or beta-galactosidase, relatively large co-proteins which solubilize the protein and facilitate production and purification thereof. Moreover, the co-protein may act as an adjuvant in the sense of providing a generalized stimulation of the immune system. The co-protein may be attached to either the amino or carboxy terminus of the first protein. Provided by this invention are compositions, particularly vaccine compositions, and methods comprising the NTHi polypeptides encoded by the polynucleotide of the invention or antigenic peptides thereof.

The invention correspondingly provides compositions suitable for eliciting an immune response to NTHi infection, wherein the antibodies elicited block binding of NTHi bacterium to the host's cells. The compositions comprise NTHi proteins or NTHi peptides of the invention, cells expressing the NTHi polypeptide, or polynucleotides encoding the polypeptides. The compositions may also comprise other ingredients such as carriers and adjuvants.

Genes that are up-regulated in NTHi infection of the middle ear and/or the nasopharynx and genes that are associated with NTHi virulence are described herein. The polypeptides and peptides thereof which are encoded by these NTHi genes are contemplated to be useful for eliciting an immune response for treating or preventing disorders associated with NTHi infection, such as OM. Some of the polypeptides encoded by these genes include: histidine biosynthesis protein, lipoprotein B, peptide ABC transporter, periplasmic SapA precursor, outer membrane lipoproteins carrier protein precursor, ribose transport system permease protein, phosphoribosylaminoimidazole carboxylase catalytic subunit, PurE, phosphoribosylaminoimidazole carboxylase catalytic subunit, ornithine carbamolytransferase, mannonate dehydratase, disulfide oxidoreductase, urease accessory protein, phosphocholine cytidylytransferase, putative pyridoxine biosynthesis protein, singlet oxygen resistance protein, intracellular septation protein, DNA repair protein, MukF protein, glycerol-3-phosphate regulon repressor, integration host factor beta subunit, arginine repressor, cold shock like protein, stress response protein, LicA, MukF, RadA and those hypothetical proteins encoded by HI0094, HI1163, HI0665, HI1292, HI1064, HI186, HI0352 genes. NTHi OMPs, LOS and noncapsular proteins are also contemplated to elicit an immune response for prevention and treatment of disorders associated with NTHi infection.

An "immunogenic dose" of a composition of the invention is one that generates, after administration, a detectable humoral and/or cellular immune response in comparison to the immune response detectable before administration or in comparison to a standard immune response before administration. The invention contemplates that the immune response resulting from the methods may be protective and/or therapeutic.

The invention includes methods of blocking binding of NTHi bacteria to host cells in an individual. The methods comprise administering antibodies or polypeptides of the invention that block binding of NTHi cellular attachment. Alternatively, administration of one or more small molecules that block binding of NTHi cell attachment is contemplated. In vitro assays may be used to demonstrate the ability of an antibody, polypeptide or small molecule of the invention to block NTHi cell attachment.

Pharmaceutical compositions comprising antibodies of the invention, polypeptides of the invention and/or small molecules of the invention that block NTHi cellular attachment are provided. The pharmaceutical compositions may consist of one of the foregoing active ingredients alone, may comprise combinations of the foregoing active ingredients or may comprise additional active ingredients used to treat bacterial infections. The pharmaceutical compositions may comprise one or more additional ingredients such as pharmaceutically effective carriers. Dosage and frequency of the administration of the pharmaceutical compositions are determined by standard techniques and depend, for example, on the weight and age of the individual, the route of administration, and the severity of symptoms. Administration of the pharmaceutical compositions may be by routes standard in the art, for example, parenteral, intravenous, oral, buccal, nasal, pulmonary, rectal, or vaginal.

Also provided by the invention are methods for detecting NTHi infection in an individual. In one embodiment, the methods comprise detecting NTHi polynucleotides of the invention in a sample using primers or probes that specifically bind to the polynucleotides. Detection of the polynucleotide may be accomplished by numerous techniques routine in the art involving, for example, hybridization and PCR.

The antibodies of the present invention may also be used to provide reagents for use in diagnostic assays for the detection of NTHi antigens (NTHi polypeptides and peptides thereof) in various body fluids of individuals suspected of *H. influenzae* infection. In another embodiment, the NTHi proteins and peptides of the present invention may be used as antigens in immunoassays for the detection of NTHi in various patient tissues and body fluids including, but not limited to: blood, serum, ear fluid, spinal fluid, sputum, urine, lymphatic fluid and cerebrospinal fluid. The antigens of the present invention may be used in any immunoassay system known in the art including, but not limited to: radioimmunoassays, ELISA assays, sandwich assays, precipitin reactions, gel diffusion precipitin reactions, immunodiffusion assays, agglutination assays, fluorescent immunoassays, protein A immunoassays and immunoelectrophoresis assays.

Vaccines and Chemotherapeutic Targets

An aspect of the invention relates to a method for inducing an immunological response in an individual, particularly a mammal which comprises inoculating the individual with a NTHi antigen protein or an antigenic peptide thereof.

The present invention also provides for vaccine formulations which comprise an immunogenic recombinant NTHi protein or NTHi peptide of the invention together with a suitable carrier. The NTHi polypeptides and peptides thereof contemplated as vaccine candidates and/or targets of chemotherapy include, but are not limited to, histidine biosynthesis protein, lipoprotein B, peptide ABC transporter, periplasmic SapA precursor, outer membrane lipoproteins carrier protein precursor, ribose transport system permease protein, phosphoribosylaminoimidazole carboxylase catalytic subunit, PurE, 3,4-dihydroxt-2-butone 4-phosphate synthase, ornithine carbamolytransferase, mannonate dehydratase, disulfide oxidoreductase, urease accessory protein, phospshocholine cytidylytransferase, putative pyridoxine biosynthesis protein, singlet oxygen resistance protein, intracellular septation protein, DNA repair protein, MUKF protein, glycerol-3-phosphate regulon repressor, integration host factor beta subunit, arginine repressor, cold shock like protein, stress response protein, LicA, RadA and those hypothetical proteins encoded by HI0094, HI1163, HI0665, HI1292, HI1064, HI1386, HI10352 genes, NTHi OMPs, NTHi LOS and NTHi noncapsular proteins and polypeptides encoded by the novel NTHi polynucleotide sequences present in the nucleotide sequences set out as SEQ ID NOS: 1-576, SEQ ID NOS: 675-685 and the nucleotide sequences set out in Table 3B, Table 4B and Table 5 herein, and the polypeptides having the amino acid sequences set out in Table 3B, Table 4B and Table 5 herein.

Since the protein may be broken down in the stomach, it is preferably administered parenterally, including, for example, administration that is subcutaneous, intramuscular, intravenous, or intradermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampules and vials and may be stored in a freeze-dried condition requiring only the addition of the sterile liquid carrier immediately prior to use. The vaccine formulation may also include adjuvant systems for enhancing the immunogenicity of the formulation, such as oil-in water systems and other systems known in the art. The dosage will depend on the specific activity of the vaccine and can be readily determined by routine experimentation.

A. Peptide Vaccines

Peptide therapeutic agents, such as peptide vaccines, are well known in the art and are of increasing use in the pharmaceutical arts. Consistent drawbacks to the parenteral administration of such peptide compounds have been the rapidity of breakdown or denaturation. Infusion pumps, as well as wax or oil implants, have been employed for chronic administration of therapeutic agents in an effort to both prolong the presence of peptide-like therapeutic agents and preserve the integrity of such agents. Furthermore, the peptide-like agent should (with particular reference to each epitope of the peptide-like agent) ideally maintain native state configuration for an extended period of time and additionally be presented in a fashion suitable for triggering an immunogenic response in the challenged animal or immunized human.

The NTHi antigenic peptides of the invention can be prepared in a number of conventional ways. The short peptides sequences can be prepared by chemical synthesis using standard means. Particularly convenient are solid phase techniques (see, e.g., Erikson et al., *The Proteins* (1976) v. 2, Academic Press, New York, p. 255). Automated solid phase synthesizers are commercially available. In addition, modifications in the sequence are easily made by substitution, addition or omission of appropriate residues. For example, a cysteine residue may be added at the carboxy terminus to provide a sulfhydryl group for convenient linkage to a carrier protein, or spacer elements, such as an additional glycine residue, may be incorporated into the sequence between the linking amino acid at the C-terminus and the remainder of the peptide. The short NTHi peptides can also be produced by recombinant techniques. The coding sequence for peptides of this length can easily be synthesized by chemical techniques, e.g., the phosphotriester method described in Matteucci et al., *J Am Chem Soc.*, 103: 3185 (1981).

Some of the NTHi peptide sequences contemplated herein may be considered too small to be immunogenic, they may be linked to carrier substances in order to confer this property upon them. Any method of creating such linkages known in the art may be used. Linkages can be formed with heterobifunctional agents that generate a disulfide link at one functional group end and a peptide link at the other, such as a disulfide amide forming agent, e.g., N-succidimidyl-3-(2-pyridyldithio) proprionate (SPDP) (See, e.g., Jansen et al., *Immun. Rev.* 62:185, 1982) and bifunctional coupling agents that form a thioether rather than a disulfide linkage such as reactive esters of 6-maleimidocaproic acid, 2-bromoacetic acid, 2-iodoacetic acid, 4-(N-maleimido-methyl) cyclohexane-1-carboxylic acid and the like, and coupling agent which activate carboxyl groups by combining them with succinimide or 1-hydroxy-2-nitro-4-sulfonic acid, for sodium salt such as succinimidyl 4-(N-maleimido-methyl)cyclohexane-1-carboxylate (SMCC).

B. Vaccine Compositions and Administration

A priming dose of the immunogen that is followed by one or more booster exposures to the immunogen may be necessary to be an effective vaccine (Kramp et al., *Infect. Immun.*, 25: 771-773, 1979; Davis et al., *Immunology Letters*, 14: 341-8 1986 1987). Examples of proteins or polypeptides that could beneficially enhance the immune response if co-administered include cytokines (e.g., IL-2, IL-12, GM-CSF), cytokine-inducing molecules (e.g. Leaf) or costimulatory molecules. Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Ideally, an immunogen will exhibit two properties; the capacity to stimulate the formation of the corresponding antibodies and the propensity to react specifically with these antibodies. Immunogens bear one or more epitopes which are the smallest part of an immunogen recognizable by the combing site of an antibody. In particular instances, immunogen, fractions of immunogens or conditions under which the immunogen is presented are inadequate to precipitate the desired immunological response resulting in insufficient immunity. This is often the case with peptides or other small molecules used as immunogens. Other substances such as immunomodulators (e.g., cytokines such as the interleukins) may be combined in vaccines as well.

The vaccine art recognizes the use of certain substances called adjuvants to potentate an immune response when used in conjunction with an immunogen. Adjuvants are further used to elicit an immune response that is faster or greater than would be elicited without the use of the adjuvant. In addition, adjuvants may be used to create an immunological response using less immunogen than would be needed without the inclusion of adjuvant, to increase production of certain antibody subclasses that afford immunological protection or to enhance components of the immune response (e.g., humoral, cellular). Known adjuvants include emulsions such as Freund's Adjuvants and other oil emulsions, *Bordetella pertussis*, MF59, purified saponin from *Quillaja saponaria* (QS21), aluminum salts such as hydroxide, phosphate and alum, calcium phosphate, (and other metal salts), gels such as aluminum hydroxide salts, mycobacterial products including muramyl dipeptides, solid materials, particles such as liposomes and virosomes. Examples of natural and bacterial products known to be used as adjuvants include monophosphoryl lipid A (MPL), RC-529 (synthetic MPL-like acylated monosaccharide), OM-174 which is a lipid A derivative from *E. coli*, holotoxins such as cholera toxin (CT) or one of its derivatives, pertussis toxin (PT) and heat-labile toxin (LT) of *E. coli* or one of its derivatives, and CpG oligonucleotides. Adjuvant activity can be affected by a number of factors, such as carrier effect, depot formation, altered lymphocyte recirculation, stimulation of T-lymphocytes, direct stimulation of B-lymphocytes and stimulation of macrophages.

Vaccines are typically prepared as injectables, either as liquid solutions or suspensions; solid forms suitable for solution in, or suspension in, liquid prior to injection may also be prepared. The preparation may also be emulsified. The active immunogenic ingredient is often mixed with excipients, which are pharmaceutically acceptable and compatible with the active ingredient. Suitable excipients are, e.g., water, saline, dextrose, glycerol, ethanol, or the like and combinations thereof. In addition, if desired, the vaccine may contain minor amounts of auxiliary substances such as wetting or emulsifying agents, pH buffering agents, or adjuvants, which enhance the effectiveness of the vaccine. The vaccines are conventionally administered parenterally, by injection, for example, either subcutaneously or intramuscularly. Additional formulations which are suitable for other modes of administration include suppositories and, in some cases, oral formulations. For suppositories, traditional binders and carriers may include, for example, polyalkalene glycols or triglycerides; such suppositories may be formed from mixtures containing the active ingredient in the range of 0.5% to 10%, preferably 1-2%. Oral formulations include such normally employed excipients as, for example, pharmaceutical grades of mannitol, lactose, starch, magnesium stearate, sodium saccharine, cellulose, magnesium carbonate and the like. These compositions take the form of solutions, suspensions, tablets, pills, capsules, sustained release formulations or powders and contain 10%-95% of active ingredient, preferably 25-70%.

Vaccines may also be administered through transdermal routes utilizing jet injectors, microneedles, electroporation, sonoporation, microencapsulation, polymers or liposomes, transmucosal routes and intranasal routes using nebulizers, aerosols and nasal sprays. Microencapsulation using natural or synthetic polymers such as starch, alginate and chitosan, D-poly L-lactate (PLA), D-poly DL-lactic-coglycolic microspheres, polycaprolactones, polyorthoesters, polyanhydrides and polyphosphazenes polyphosphatazanes are useful for both transdermal and transmucosal administration. Polymeric complexes comprising synthetic poly-ornithate, poly-lysine and poly-arginine or amphipathic peptides are useful for transdermal delivery systems. In addition, due to their amphipathic nature, liposomes are contemplated for transdermal, transmucosal and intranasal vaccine delivery systems. Common lipids used for vaccine delivery include N-(1)2,3-(dioleyl-dihydroxypropyl)-N,N,N,-trimethylammonium-methyl sulfate (DOTAP), dioleyloxy-propyl-trimethylammonium chloride DOTMA, dimystyloxypropyl-3-dimethyl-hydroxyethyl ammonium (DMRIE), dimethyldioctadecyl ammonium bromide (DDAB) and 9N(N',N-dimethylaminoethane)carbamoyl) cholesterol (DC-Chol). The combination of helper lipids and liposomes will enhance up-take of the liposomes through the skin. These helper lipids include, diolcoyl phosplhatidylethanolamine (DOPE), dilauroylphosphatidylethanolamine (DLPE), dimyristoyl phosphatidylethanolamine (DMPE), dipalmitoylphosphatidylethanolamine (DPPE). In addition, triterpenoid glycosides or saponins derived from the Chilean soap tree bark (*Quillaja saponaria*) and chitosan (deacetylated chitan) have been contemplated as useful adjuvants for intranasal and transmucosal vaccine delivery.

The proteins may be formulated into the vaccine as neutral or salt forms. Pharmaceutically acceptable salts, include the acid addition salts (formed with the free amino groups of the peptide) and which are formed with inorganic acids such as, e.g., hydrochloric or phosphoric acids, or such organic acids as acetic, oxalic, tartaric, mandelic. Salts formed with the free carboxyl groups may also be derived from inorganic bases such as, e.g., sodium, potassium, ammonium, calcium, or ferric hydroxides, and such organic bases as isopropylamine, trimethylamine, 2-ethylamino ethanol, histidine, and procaine.

The vaccines are administered in a manner compatible with the dosage formulation, and in such amount as will be therapeutically effective and immunogenic. The quantity to be administered depends on the subject to be treated, capacity of the subject's immune system to synthesize antibodies, and the degree of protection desired. Precise amounts of active ingredient required to be administered depend on the judgment of the practitioner and are peculiar to each individual. However, suitable dosage ranges are of the order of several hundred micrograms active ingredient per individual. Suitable regimes for initial administration and booster shots are also variable, but are typified by an initial administration followed in one or three month intervals by a subsequent injection or other administration.

Upon immunization with a vaccine composition as described herein, the immune system of the host responds to the vaccine by producing large amounts of CTLs specific for the desired antigen, and the host becomes at least partially immune to later infection, or resistant to developing chronic infection. Vaccine compositions containing the NTHi polypeptide or NTHi peptides of the invention are administered to a patient susceptible to or otherwise at risk of bacterial infection to elicit an immune response against the antigen and thus enhance the patient's own immune response capabilities. Such an amount is defined to be an "immunogenically effective dose." In this use, the precise amounts again depend on the patient's state of health and weight, the mode of administration, the nature of the formulation, etc., but generally range from about 1.0 µg to about 5000 per 70 kilogram patient, more commonly from about 10 to about 500 mg per 70 kg of body weight. For therapeutic or immunization purposes, the NTHi polypeptide or NTHi peptides of the invention can also be expressed by attenuated viral hosts, such as vaccinia or fowlpox. This approach involves the use of vaccinia virus as a vector to express nucleotide sequences that encode the peptides of the invention. Upon introduction into an acutely or chronically infected host or into a noninfected host, the recombinant vaccinia virus expresses the immunogenic peptide, and thereby elicits a host CTL response.

Humoral immune response may be measured by many well known methods, such as Single Radial Inmunodiffussion Assay (SRID), Enzyme Immunoassay (EIA) and Hemagglutination Inhibition Assay (HAI). In particular, SRID utilizes a layer of a gel, such as agarose, containing the immunogen being tested. A well is cut in the gel and the serum being tested is placed in the well.

Diffusion of the antibody out into the gel leads to the formation of a precipitation ring whose area is proportional to the concentration of the antibody in the serum being tested. EIA, also known as ELISA (Enzyme Linked Immunoassay), is used to determine total antibodies in the sample. The immunogen is adsorbed to the surface of a microtiter plate. The test serum is exposed to the plate followed by an enzyme linked immunoglobulin, such as IgG. The enzyme activity adherent to the plate is quantified by any convenient means such as spectrophotometry and is proportional to the concentration of antibody directed against the immunogen present in the test sample. HAI utilizes the capability of an immunogen such as viral proteins to agglutinate chicken red blood cells (or the like). The assay detects neutralizing antibodies, i.e., those antibodies able to inhibit hemagglutination. Dilution of the test serum are incubated with a standard concentration of immunogen, followed by the addition of the red blood cells. The presence of neutralizing antibodies will inhibit the agglutination of the red blood cells by the immunogen. Tests to measure cellular immune response include determination of delayed-type hypersensitivity or measuring the proliferative response of lymphocytes to target immunogen.

Nontypeable *Haemophilus influenzae* (NTHi) p *H. influenzae* is a small, nonmotile gram negative bacterium. Unlike other *H. influenzae* strains, the nontypeable *H. influenzae* (NTHi) strains lack a polysaccharide capsule and are sometimes denoted as "nonencapsulated." NTHi strains are genetically distinct from encapsulated strains and are more heterogenous than the type b *H. influenzae* isolates. NTHi presents a complex array of antigens to the human host. Possible antigens that may elicit protection include OMPs, lipopolysaccharides, lipoproteins, adhesion proteins and noncapsular proteins.

Humans are the only host for *H. influenzae*. NTHi strains commonly reside in the upper respiratory tract including the nasopharynx and the posterior oropharynx, the lower respiratory tract and the female genital tract. NTHi causes a broad spectrum of diseases in humans, including but not limited to, otitis media, pneumonia, sinusitis, septicemia, endocarditis, epiglottitis, septic arthritis, meningitis, postpartum and neonatal infections, postpartum and neonatal sepsis, acute and chromic salpingitis, epiglottis, pericarditis, cellulitis, osteomyelitis, endocarditis, cholecystitis, intraabdominal infections, urinary tract infection, mastoiditis, aortic graft infection, conjunctitivitis, Brazilian purpuric fever, occult bacteremia and exacerbation of underlying lung diseases such as chronic bronchitis, bronchietasis and cystic fibrosis.

Epidemiologic studies of NTHi have indicated that the strains are heterogeneous with respect to outer membrane protein profiles (Barenkamp et al., *Infect. Immun.*, 36: 535-40, 1982), enzyme allotypes (Musser et al., *Infect. Immun.*, 52: 183-191, 1986), and other commonly used epidemiologic tools. There have been several attempts to subtype NTHi, but none of the methodologies have been totally satisfactory. The outer-membrane protein composition of NTHi consists of approximately 20 proteins. All NTHi strains contains two common OMP's with molecular weights of 30,000 and 16,600 daltons. NTHi strains may be subtyped based on two OMP's within the 32,000-42,000 dalton range. The NTHi liposaccharide profile is fundamentally different than the enteric gram negative bacteria and separates into 1-4 distinct bands ranging from less than 20,000 daltons.

A prototype NTHi isolate is the low passage isolate 86-028NP which was recovered from a child with chronic otitis media. This strain has been well characterized in vitro (Bakaletz et al., *Infect. Immun.*, 53: 331-5, 1988; Holmes et al., *Microb. Pathog.*, 23: 157-66, 1997) as well as in the chinchilla OM model (described herein) (Bakaletz et al., *Vaccine*, 15: 955-61, 1997; Suzuki et al., *Infect. Immun.*, 62: 1710-8, 1994; DeMaria et al., *Infect. Immun.*, 64: 5187-92, 1996). The 86-028NP strain was used, as described herein, to identify genes that are up-regulated in expression in the chinchilla model of otitis media and genes that are necessary for NTHi survival in the chinchilla middle ear.

DFI Strategy

A differential fluorescence induction (DFI) strategy was used herein to identify NTHi genes induced during GM in a chinchilla animal model. Several methods have been developed to identify bacterial genes that contribute to the virulence of an organism during infection. Such methods include in vivo expression technology (IVET) in which bacterial promoters regulate the expression of gene(s) required for synthesis of essential nutrients required for survival in the host; signature-tagged mutagenesis (STM) enabling tag-specific identification of genes that alter the virulence properties of a microorganism when mutated; DNA microarray technology to globally screen for transcriptionally active genes, and DFI which uses Fluorescent Activated Cell Sorting (FACS) analysis to select for transcriptionally active promoters (Chiang et al., *Annu. Rev. Microbiol.*, 53: 129-154, 1999). DFI is a high-throughput method that allows for the identification of differentially regulated genes regardless of the basal level of expression and does not exclude those that are essential for growth in vitro.

DFI has been successfully utilized in many microorganisms. For example, a Green Fluorescent Protein (GFP) reporter system and flow cytometry was used to study mycobacterial gene expression upon interaction with macrophages (Dhandayuthapani et al., *Mol. Microbiol.*, 17: 901-912, 1995). A promoter trap system was used to identify genes whose transcription was increased when *Salmonellae* were subjected to environments simulating in vivo growth and when internalized by cultured macrophage-like cells (Valdivia and Falkow, *Mol. Micro boil.*, 22: 367-378, 1996; Valdivia and Falkow, *Science,* 277: 2007-2011, 1997; Valdivia and Falkow, *Curr. Opin. Microbiol.,* 1:359-363, 1998). In addition, DFI has been used to identify promoters expressed in S. pneumoniae and S. aureus when grown under varied in vitro conditions simulating infection (Marra et al., *Infect. Immun.,* 70(3): 1422-1433, 2002; Schneider et al., *Proc. Nati. Acad. Sci.* U.S.A., 97: 1671-1676, 2000). In addition, DFI has been utilized to study gene regulation in *Bacillus cereus* in response to environmental stimuli (Dunn and Handelsman, *Gene,* 226: 297-305, 1999), in S. pneumoniae in response to a competence stimulatory peptide (Bartilson et al., *Mol. Microbiol.*, 39: 126-135, 2001), and upon interaction with and invasion of host cells in *Bartonella henselae* Lee and Falkow, *Infect. Immun.,* 66: 3964-3967, 1998), *Listeria monocytogenes* Wilson et al., *Infect. Immun.,* 69: 5016-5024, 2001), *Brucella abortus* (Eskra et al., *Infect. Immun.,* 69: 7736-7742, 2001), and *Escherichia coli* (Badger et al., *Mol. Microbiol.,* 36: 174-182, 2000).

Whereas DFI has been successfully used to identify promoters active in cell culture models of infection or in vitro conditions designed to simulate an in vivo environment, few have applied DFI to identify promoters regulated in a specific biological niche within the whole animal. This is likely due to the numerous challenges associated with sorting from an in vivo environment. The host inflammatory response, dissemination and/or clearance of bacterial cells from the site of infection, as well as adherence of bacteria to epithelial cells, possibly via biofilm formation, can make bacteria inaccessible for retrieval from the living animal. These factors, among others, contribute to the complexity of the microenvironment and the heterogeneity of gene expression as the bacteria sense and respond to these changes. Recently, DFI has been used to identify promoters expressed in *S. pneumoniae* when the bacteria were screened in a mouse model of respiratory tract infection and a gerbil infection model of OM (Marra et al., *Infect. Immun.* 70: 1422-33, 2002; Marra et al., *Microbiol.,* 148: 1483-91, 2002).

Animal Model

The chinchilla model is a widely accepted experimental model for OM. In particular, a chinchilla model of NTHi-induced OM has been well characterized (Bakaletz et al., *J. Infect. Dis.,* 168: 865-872, 1993; Bakaletz and Holmes, *Clin. Diagn. Lab. Immunol.,* 4: 223-225, 1997; Suzuki and Bakaletz, *Infest. Immun.,* 62: 1710-1718, 1994), and has been used to determine the protective efficacy of several NTHi outer membrane proteins, combinations of outer membrane proteins, chimeric synthetic peptide vaccine components, and adjuvant formulations as vaccinogens against OM (Bakaletz et al., *Vaccine,* 15; 955-961, 1997; Bakaletz et al., *Infect. Immun.,* 67: 2746-2762, 1999; Kennedy et al., *Infect. Immun.,* 68: 2756-2765, 2000).

In particular, there is an unique in vivo model wherein adenovirus predisposes chinchillas to *H. influenzae*-induced otitis media, which allowed for the establishment of relevant cell, tissue and organ culture systems for the biological assessment of NTHi (Bakaletz et al., *J. Infect. Dis.,* 168: 865-72, 1993; Suzuki et al., *Infect. Immunity* 62: 1710-8, 1994). Adenovirus infection alone has been used to assess for the transudation of induced serum antibodies into the tympanum (Bakaletz et al., *Clin. Diagnostic Lab Immunol.,* 4(2): 223-5, 1997) and has been used as a co-pathogen with NTHi, to determine the protective efficacy of several active and passive immunization regimens targeting various NTHi outer membrane proteins, combinations of OMPs, chimeric synthetic peptide vaccine components, and adjuvant formulations as vaccinogens against otitis media (Bakaletz et al., *Infect Immunity,* 67(6): 2746-62, 1999; Kennedy et al., *Infect Immun.,* 68(5): 2756-65, 2000; Novotny et al., *Infect Immunity* 68(4): 2119-28, 2000; Poolman et al., *Vaccine* 19 (Suppl. 1): S108-15, 2000).

Genes Upregulated In Vivo in Response to NTHi Infection of the Middle Ear

In order to identify differentially regulated promoters in response to NTHi infection of the middle ear, a promoter trap library was constructed and sorting parameters defined. A portion of the promoter trap library was inoculated directly into the chinchilla middle ear and OM development was monitored by video otoscopy and tympanometry at 24 and 48 hours. In addition, the middle ear fluids were recovered 24 and 48 hours after infection. Two-color FACS analysis was used to isolated bacteria that were expressing GFP from other cells and debris associated with the effusion. Following isolation, DNA sequence of the *Haemophilus* inserts 5' of the gfpmut3 gene were determined and analyzed. In this manner, we identified genes that are up-regulated as NTHi sense and respond to the environment of the chinchilla middle ear during AOM. The following genes were identified and due to their up-regulation during NTHi infection, they may play a role in NTHi infection and virulence.

As described below in Example 7, following the DFI procedure described above and subsequent FACS analysis of gfp-expressing clones, 52 candidate clones containing potential in vivo-regulated promoters were isolated. The genes these clones control were categorized based upon general description and function within the cell and include general metabolic processes, environmental informational processing and membrane transport, membrane proteins and hypothetical proteins. Eight of these 52 clones contain sequences that are unique to NTHi strain 86-028NP. Importantly, 3 clones were isolated from independent screens in more than one animal thereby verifying the method of isolation.

In order to independently confirm the FACS data, we determined the relative expression of candidate genes by quantitative Reverse Transcriptase-Polymerase Chain Reaction (RT-PCR). The parent strain 86-028NP, was used for these studies. Thus, wild-type gene expression without the influence of plasmid copy number on gene regulation was analyzed, allowing for the indication of false-positive clone identification by FACS. Of the 44 candidate clones containing sequence similar to that identified in *H. influenzae* strain Rd, quantitative comparison of gene expression in vitro and in vivo confirmed up-regulated gene expression for twenty-six genes (60%) when NTHi respond to environmental cues present in the chinchilla middle ear. This analysis identified in vivo-regulated promoters which drive expression of genes involved in membrane transport, environmental informational processing, cellular metabolism, gene regulation, as well as hypothetical proteins with unknown function. (See Table 4 in Example 6).

Quantitative RT-PCR demonstrated a two-fold increase in lolA expression, enabling lipoprotein transport from the inner membrane to the outer membrane. Bacteria grow rapidly in the middle ear environment reaching $5.0\times10^8$ CFU NTHi ml middle ear fluid within 48 hours. The bacteria sense and respond to the environment, acquiring or synthesizing the necessary nutrients for growth and survival. The gene encoding the membrane component in ribose sugar transport, rbsC (SEQ ID NO: 619), showed a 5-fold increase in expression in vivo compared to cells growing in vitro. In addition, many genes involved in metabolic processes show a dramatic increase in gene expression in vivo compared to cells growing in vitro. These include a riboflavin synthesis gene, ribB (SEQ ID NO: 623), a purine nucleotide biosynthetic gene purE (SEQ ID NO: 621), ornithine carbamoyltransferase, arcB (SEQ ID NO: 625), involved in arginine degradation via the urea cycle and uxuA (SEQ ID NO: 627), encoding mannonate hydrolase, required for the uptake of D-glucuronate and transformation into glyceraldehyde 3-phosphate. In addition, but to a lesser degree, genes for histidine biosynthesis (hisB; SEQ ID NO: 615), DNA repair (radC; SEQ ID NO: 639) and a putative intracellular septation transmembrane protein (ispZ; SEQ ID NO: 637) were up-regulated.

Disulfide bond formation is important for folding and assembly of many secreted proteins in bacteria. In prokaryotes, DsbA and DsbB make up the oxidative pathway responsible for the formation of disulfides. DsbB reoxidizes DsbA, which donates disulfide bonds directly to unfolded polypeptides, and DsbB has been demonstrated to generate disulfides de novo from oxidized quinones (Collet and Bardwell, *Mol. Microbiol.*, 44: 1-8, 2002). In *H. influenzae* strain Rd, DsbA is required for competence for transformation (Tomb, *Proc. Natl. Acad. Sci. U.S.A.*, 89: 10252-10256, 1992). Herein, an approximate 3-fold increase in dsbB gene (SEQ ID NO: 629) transcription was demonstrated, illuminating an important role for disulfide interchange for NTHi growing in the middle ear environment.

Bacteria colonization of the middle ear, a normally sterile environment, results in a host inflammatory response and subsequent neutrophil infiltration. Bacteria have evolved numerous strategies to combat this host response. NTHi increase gene expression (4-fold) of ureH (SEQ ID NO:631), a homologue of a gene required for expression of active urease in *Helicobacter*, shown to be involved in acid tolerance (Young et al., *J. Bacteriol.*, 178: 6487-6495, 1996). Recently, it has been reported that urease activity may play a role in chronic *Actinobacillus pleuropneumoniae* infection by counteracting the decrease in pH occurring upon infection (Baltes et al., *Infect. Immun.*, 69: 472-478, 2000; Baltes et al., *Infect. Immun.*, 69: 472-478, 2001; Bosse and MacInnes, *Can. J. Vet. Res.*, 64: 145-150). A biotype analysis on NTHi isolates from middle ear effusions demonstrated that 87% are urease positive (DeMaria et al., *J. Clin. Microbiol.*, 20: 1102-1104, 1984). However, the role of urease in NTHi virulence is unknown. Similarly, an increase in expression of a gene whose product demonstrates 88% sequence identity to a pyridoxine biosynthesis protein in *S. pneumoniae* and 60% homology to a putative singlet oxygen resistance protein that may function as an antioxidant. Phosphorylcholine (ChoP) has been implicated in the pathogenesis of NTHi (Weiser et al., *Infect. Immun.*, 65: 943-950, 1997). NTHi modulates ChoP expression by phase variation, decorating the LOS on the cell surface. ChoP may contribute to NTHi persistence in the respiratory tract via decreased susceptibility to antimicrobial peptides (Lysecko et al., *Infect. Immun.*, 68: 1664-1671, 2000) and alter the sensitivity to serum killing mediated by C-reactive protein (CRP) (Weiser et al., *J. Exp. Med.*, 187: 631-640, 1998). The microenvironment of the nasopharynx and middle ear cavity may select for the ChoP$^+$ phenotype, as ChoP$^+$ strains show greater colonization of the chinchilla nasopharynx (Tong et al., *Infect. Immun.*, 68: 4593-4597, 2000). Expression of the licC gene (SEQ ID NO: 633) was also increased. The licC gene encodes a phosphorylcholine cytidylyltransferase that plays a role in the biosynthesis of phosphorylcholine-derivatized LOS (Rock et al., *J. Bacteriol.*, 183: 4927-4931, 2001).

Also included among the in vivo-induced genes is a set whose products subsequently regulate gene expression or DNA replication. These genes include transcriptional regulation of glycerol metabolism by the glp repressor, glpR (SEQ ID NO: 643), the arginine repressor gene, argR (SEQ ID NO: 647), and the integration host factor (IHF) beta subunit, ihfB (SEQ ID NO: 645). IHF is a histone-like protein that binds DNA at specific sequences, an accessory factor involved in replication, site-specific recombination and transcription, altering the activity of a large number of operons (Goosen and van de Putte, *Mol. Microbiol.* 16: 1-7, 1995). In addition, CspD inhibits DNA replication during stationary phase-induced stress response in *E. coli* (Yamanaka et al., *Mol. Microbiol.*, 39: 1572-1584, 2001) and the mukF (SEQ ID NO: 641) gene protein homologue contributes to a remodeling of the nucleiod structure into a more compact form prior to cell segregation (Sawitzke and Austin, *Proc. Natl. Acad. Sci. U.S.A.*, 62: 1710-1718, 2000). The DFI strategy described herein also identified promoters induced in vivo for genes of unknown function. The hypothetical protein, HI0094, demonstrated an 8-fold increase in gene expression during early OM but its role remains unknown. HI1163 (SEQ ID NO: 651) showed 58% amino acid identity with the hypothetical YdiJ proteins, a putative oxidase, of *E. coli*.

A high-density transposon mutagenesis strategy was used to identify *H. influenzae* genes essential for growth on rich medium (Akerley et al., *Proc. Natl. Acad. Sci. U.S.A.*, 99: 966-971, 2002). Six genes were identified in the screen described herein that are included in essential gene set described in Akerley' et al., supra. (hisB, lppB, lolA, ispZ, mukF and unknown HI0665). Recently genes of non-typeable *H. influenzae* that are expressed upon interaction with two human respiratory tract-derived epithelial cell lines have been identified. These genes included those involved in metabolic processes, stress responses, gene expression, cell envelope biosynthesis, DNA-related processes, cell division and ORF's encoding proteins of unknown function. (Ulsen et al., *Mol. Microbiol.*, 45:485-500, 2,002). Similarly the stress response gene, cspD (SEQ ID NO: 649), genes involved in purine and riboflavin biosynthesis, and a protein of unknown function, vapA was identified in the screen described herein. Expression of vapA was detected in vitro, yet vapA gene expression increased two-fold in vivo. These unique approaches identified known genes that are upregulated in NTHi-induced OM and therefore are likely to play a role in NTHi infection and virulence; and may be potential candidates for vaccines and antisense therapies and other therapeutic methods of treatment of NTHi related disorders.

The DFI strategy resulted in the identification of promoters induced in vivo for genes of unknown function as well. The hypothetical protein, HI0094, demonstrated a 8-fold increase in gene expression during early OM but its role remains unknown. HI1163 (SEQ ID NO: 651) showed 58% amino acid identity with the hypothetical YdiJ proteins, a putative oxidase, of *E. coli*. Therefore, these hypothetical genes are likely to play a role in OM induced by NTHi infection.

BRIEF DESCRIPTION OF FIGURES

FIGS. 3A-3M set out the nucleotide sequences (SEQ ID NOS: 589-614) described in Table 4, which were identified to be upregulated during OM infection (see Example 6). The nucleotides (nt.) which correspond to known genes and those nt. which correspond to the contig sequences set out as SEQ ID NO: 1-576 are also presented.

DETAILED DESCRIPTION

Figure 1:
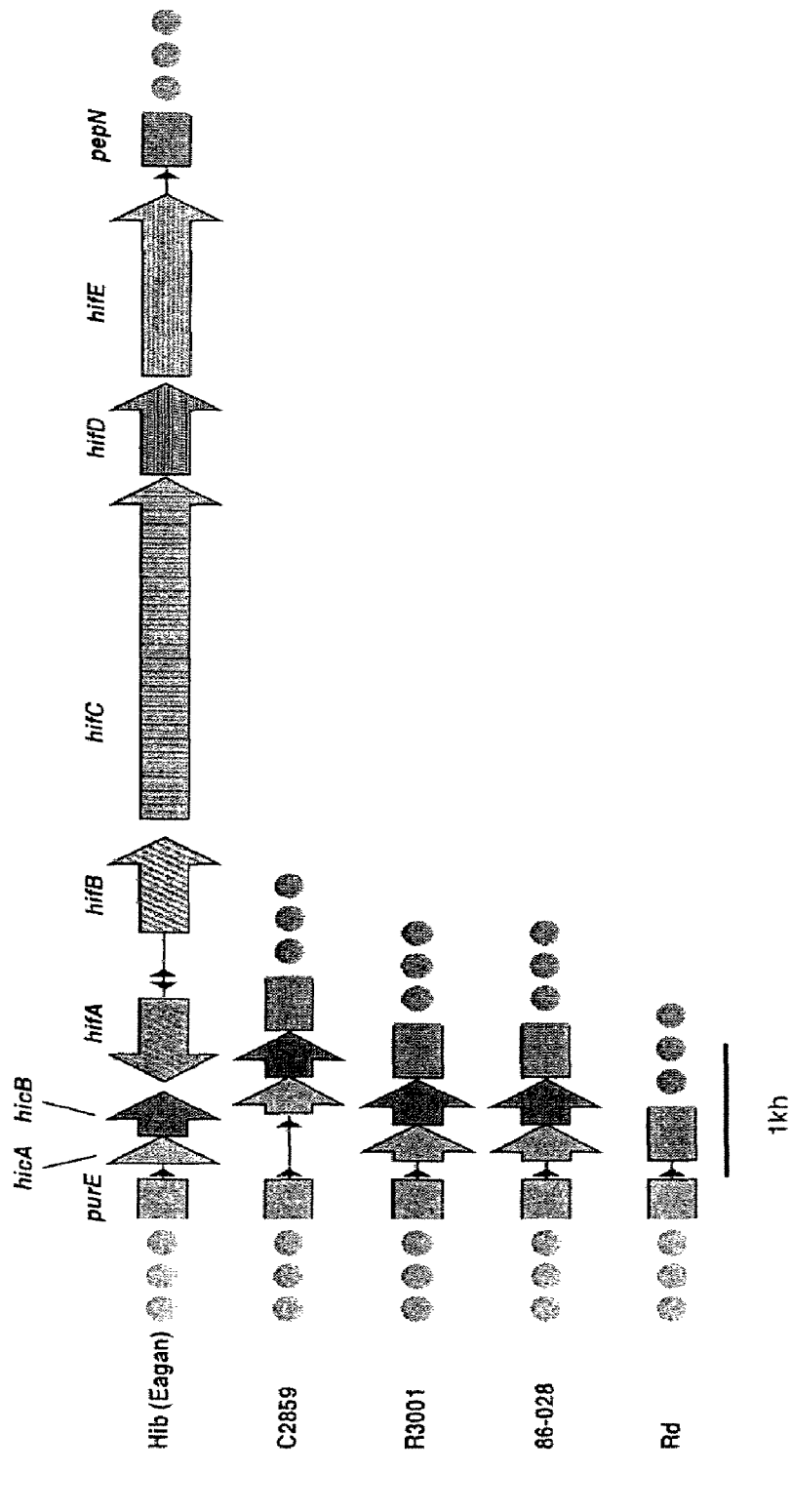
FIG. 1 depicts the LKP gene region in a panel of *Haemophilus* isolates. The strain 86-028NP sequence is identical in this region to the sequence in NTHi strain R3001. Both of these NTHi lack the hif gene cluster encoding the hemagglutinating pilus.

The following examples illustrate the invention wherein Example 1 describes the sequence of the NTHi genome, Example 2 describes the identified contigs and initial gene discovery, Example 3 describes construction of the NTHi promoter trap library, Example 4 describes the analyses of 86-028NP derivatives expressing GFP, Example 5 demonstrates direct labelling of bacteria from middle ear fluids, Example 6 describes identification of promoters induced in vivo in acute otitis media, Example 7 describes identification of virulence-associated genes, and Example 8 describes identification of unique NTHi gene sequences.

EXAMPLE 1

Sequence of a Non-Typeable *Haemophilus influenzae* Genome

NTHi strain 86-028NP is a minimally passaged clinical isolate obtained from a pediatric patient who underwent tympanostomy and tube insertion for chronic OM at Columbus Children's Hospital. (Bakaletz et al. *Infection and Immunity*, 56(2): 331-335, 1988) The 86-028NP strain was deposited with the American Type Tissue Collection (Manassas, Va. 20108 USA) on Oct. 16, 2002 and assigned accession no. PTA-4764.

In an effort to more broadly approach the identification of the virulence determinants in NTHi, the genome of the NTHi 86-028NP strain was sequenced to 3-fold coverage. Chromosomal DNA was prepared from strain 86-028NP using the Puregene protocol and sheared to 2-4 kb in size with a Hydroshear instrument (Gene Machines). The sheared DNA was ethanol-precipitated, end-repaired using a mixture of Klenow enzyme and T4 DNA polymerase, and size-selected by agarose gel electrophoresis to obtain 2-4 kb fragments as described in Chissoe et al. (*Methods: a Companion to Methods of Enzymology* 3: 55-65, 1991) and Sambrook et al. (*Molecular Cloning: a Laboratory Manual*, $2^{nd}$ Ed. Cold Springs Harbor, N.Y., 1989). These fragments were cloned into vector pUC18 using the SmaI restriction site (phosphatase-treated) and transformed into *E. coli* XL-1 Blue, selecting for ampicillin resistance. Colonies that contain inserts were identified by blue/white screening on LB-Amp plates containing X-gal, and transferred into 96-deep well plates containing 1.5 ml of TB-Amp (TB=Terrific Broth) broth. The deep-well plate cultures were grown overnight (18-22 hours) at 37° C. Template preparation, sequencing and contig assembly were performed.

Automated template preparation was performed on the Beckman Biomek 2000 automated robotics workstation as described in Chissoe et al., (supra.) Briefly, each 96-deep well plate, containing the clones prepared above, was centrifuged to pellet the cells, the supernatant decanted, and the cells frozen (if necessary) at −20° C. Four 96-deep well blocks were placed on the Biomek table, and the liquid handling robot was used to prepare the template using an automated version of a typical SDS-NaOH lysis protocol as described in Chissoe et al., (supra.). The final ethanol-precipitated templates were each dissolved in 50 µl ddH$_2$O, and used for DNA sequencing.

Sequencing reactions were run by re-arraying the templates (from 96-well plates) into 384-well plates, using the Robbins Hydra 96 robot. Cycle-sequencing reactions were run using PE Big-Dye™ terminators and universal primers (M13 forward and reverse), cleaned up over Sephadex G50 columns, and analyzed on a PE Biosystems 3700 capillary electrophoresis DNA sequencer according to the manufacturer's instructions. Sequencing reads (8219) were assembled into 576 contigs (SEQ ID NOS: 1-576 herein). The statistics for the 3-fold sequencing are shown in Table 2A. The total unique sequence in assembly 17 is 1.74 Mb.

TABLE 2A

| Contig Size | Total Number | Total Length | % of Cumulative |
|---|---|---|---|
| 0-1 kb | 65 | 55961 | 3.2% |
| 1-2 kb | 228 | 333665 | 19.2% |
| 2-3 kb | 101 | 243059 | 14.0% |
| 3-4 kb | 49 | 172385 | 9.9% |
| 4-5 kb | 45 | 196699 | 11.3% |
| 5-10 kb | 74 | 515152 | 29.6% |
| 10-20 kb | 11 | 144591 | 8.3% |
| 20-30 kb | 3 | 77352 | 4.4% |

Subsequently, 8-fold sequencing analysis of the NTHi genome was carried out. The 8-fold sequencing assembled the NTHi genome into 11 contigs. Contigs 5, 8, 9, 10, 12-18 are denoted as SEQ ID NOS: 675-685 herein. The statistics for the 8-fold sequencing are shown in Table 2B.

TABLE 2B

| Contig Size | Total Number | Total Length | % of Cumulative |
|---|---|---|---|
| 0-1 kb | 5 | 3950 | 0.2% |
| 1-2 kb | 3 | 4316 | 0.2% |
| 2-3 kb | 0 | 0 | 0.0% |
| 3-4 kb | 1 | 3964 | 0.2% |
| 4-5 kb | 0 | 0 | 0.0% |
| 5-10 kb | 0 | 0 | 0.0% |
| 10-20 kb | 1 | 15147 | 0.8% |
| 20-30 kb | 2 | 51888 | 2.7% |
| 30-40 kb | 0 | 0 | 0.0% |
| 40-50 kb | 0 | 0 | 0.0% |
| 50-100 kb | 1 | 85814 | 4.5% |
| >100 kb | 5 | 1760339 | 91.4% |

EXAMPLE 2

Contig Description and Initial Gene Discovery

Seventy-five of the 88 contigs with length≧5000bp, identified with the 3-fold sequence analysis, show significant similarity via BLASTN to genes in *H. influenzae* strain Rd. To visualize the potential relationship between the gene order in *H. influenzae* strain 86-028NP and *H. influenzae* strain Rd, the 86-028NP three-fold contig set and the Rd gene set were bidirectionally compared using BLASTN. The results were plotted in gene-order verses contig space by sorting the contigs based on gene coordinates of the Rd genes hit, anchoring each contig at the smallest coordinate found as described in Ray et al., (*Bioinformatics* 17: 1105-12, 2001). Compared in this fashion, an incomplete assembly of a genome with identical gene order to a completely known genome would display a monotonically increasing stair-stepped form.

BLASTX was used to identify hits to sequences with homology to genes in the strain Rd genome as well as genes not found in *H. influenzae* strain Rd. Hits to strain Rd sequences were removed from the data set and the other hits summarized in Table 3A. The data are presented as follows: contig # (=SEQ ID NO: #), column 1; E score for each hit, column 2; the name of the protein that had homology to a portion of the amino acid translation of the cited contig, column 3; the organism producing the homologue, column 4; and the Genbank protein identifier for each of the proteins cited in column 3, column 5; the corresponding nucleotides within the contig (referenced by SEQ ID NO:). In most instances, several homologues were identified but for clarity, the protein of greatest homology is cited in Table 3A.

The sequences for some of the genes listed in Table 3A were identified within the 8-fold sequencing of the NTHi genome. Table 3B lists the location of these genes within the 11 contigs, the full length open reading frame sequence (identified by SEQ ID NO:), the derived amino acid sequence encoded by the open reading frame and the gene with high homology identified by BLASTX (as listed in Table 3A).

Figure 2:
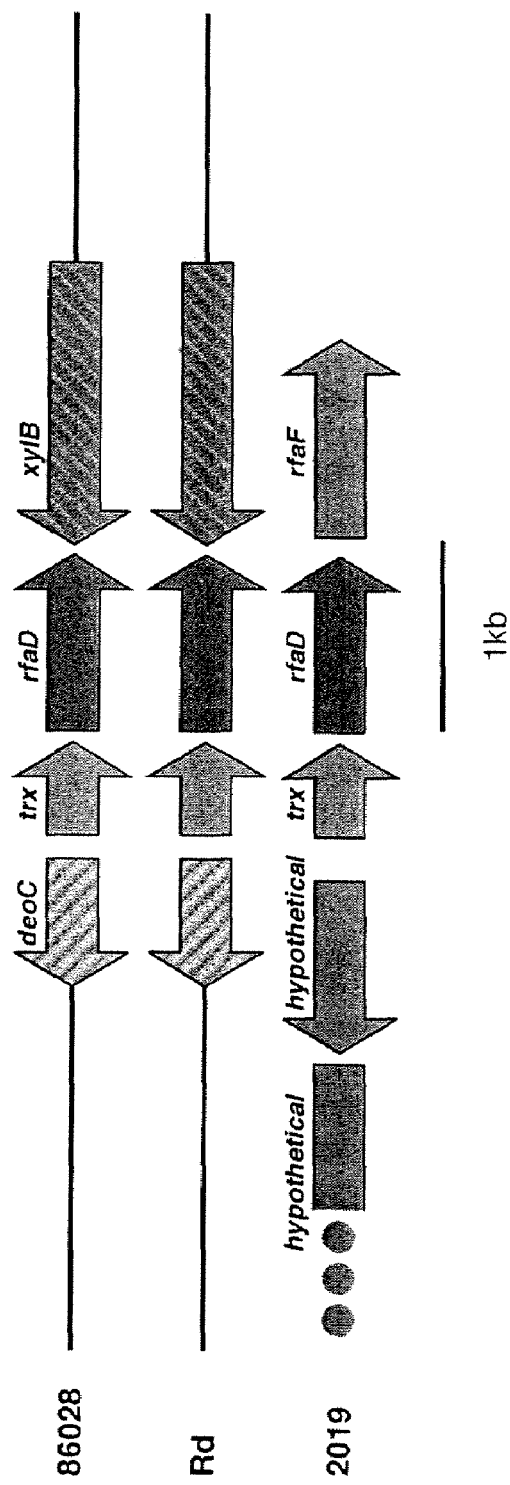
FIG. 2 depicts the rfaD region in a panel of *Haemophilus* isolates. The gene arrangement in the rfaD region of the strain 86-028NP genome is similar to that of the strain Rd genome but different than the arrangement of these genes seen in the genome of most NTHi examined.

To examine the relative short range gene arrangements in NTHi and the Rd strain, the gene order in two gene clusters that have been well-described were compared. First, the genes present in the hemagglutinating pilus (LKP) gene region were examined. (Mhlanga-Mutangadura et al., *J. Bacteriol.* 180(17): 4693-703, 1998). The pilus gene cluster is located between the purE and pepN genes, only fragments of which are depicted in FIG. 1. The serotype b strain, Eagan, contains the hifABCDE gene cluster and produces hemagglutinating pili. Strain Rd lacks the hicAB genes as well as the hifABCDE gene cluster. In general, the nontypeable strains previously examined contained the hicAB genes but not the hifgenes that encode the hemagglutinating pilus. The strain 86-028NP sequence (described herein) is identical in this region to the sequence in NTHi strain R3001 (FIG. 1). The rfaD gene encodes an enzyme involved in the biosynthesis of endotoxin. In addition, the rfaD gene from NTHi strain 2019 has been characterized by Nichols et al. (*Infect Immunity* 65(4): 1377-86, 1997). In strain 2019, the rfaD gene is immediately upstream of the rfaF gene that encodes another enzyme involved in endotoxin biosynthesis. The gene arrangement in strain Rd is different; the rfaD and rfaF genes are separated by approximately 11 kb of sequence. Most nontypeable strains examined contained the gene arrangement seen in strain 2019. In contrast, strain 86-028NP has a gene arrangement identical to that seen in strain Rd (FIG. 2).

A global analysis of the current assembly indicates that the gene content and order are similar to that in strain Rd. A more detailed analysis revealed that there are a substantial number of NTHi genes not previously seen in the *Pasteurellaceae* and some regions where the NTHi gene content and order is different than that seen in strain Rd. Thus, the current data suggest that the strain 86-028NP genome will contain a complex mosaic of Rd and non-Rd like features.

The DFI strategy also identified novel NTHi sequences that had increased gene expression. A list of these novel contig sequences that contain genes or gene fragments that have homology to ORFs in other organisms (primarily gram-negative bacteria) is set out in Table 3A. For example, the nucleotide sequence of contig 442 (SEQ ID NO: 442), nucleotides 1498-1845 are highly homologous to the sequences encoding amino acids 1-116 of *H. influenzae* strain Rd lipoprotein B (LppB). The gene is positioned between the stationary phase survival gene, surE, and a gene encoding a 43 kD antigenic outer membrane lipoprotein that is highly homologous to the recently identified bacterial lipoprotein, LppB/NlpD, which has been associated with virulence (Padmalayam et al., *Infect. Immun.*, 68: 4972-4979, 2000). Recently, Zhang and coworkers demonstrated that nlpD and sure gene expression was induced during stationary phase of bacterial growth in *Thermotoga maritima* (Zhang et al., *Structure (Camb)*, 9: 1095-1106, 2001). Therefore, under stress-induced conditions in the middle ear, this NTHi lipoprotein may be expressed.

TABLE 3A

| Contig | E score | Hit Identity | Organism | Genbank Protein | SEQ ID NO: |
|---|---|---|---|---|---|
| 104 | 4.00E−59 | CpdB | *Pasteurella multocida* | NP_246953.1 | nt. 204-659 of SEQ ID NO: 104 |
| 106 | 9.00E−10 | hypothetical protein PH0217- | *Pyrococcus horikoshii* | G71244 | nt. 40-309 of SEQ ID NO: 106 |
| 106 | 1.00E−08 | unknown | *Pasteurella multocida* | NP_246871.1 | nt. 605-694 of SEQ ID NO: 106 |
| 106 | 200E−20 | Orf122 | *Chlorobium tepidum* | AAG12204.1 | nt. 7-210 of SEQ ID NO: 106 |
| 110 | 3.00E−05 | ArdC antirestriction protein | IncW plasmid pSa | AAD52160.1 | compliment of nt. 959-1162 of SEQ ID NO: 110 |
| 110 | 1.00E−33 | hypothetical protein | *Salmonella enterica* subsp. *enterica* serovar Typhi | NP_458676.1 | compliment of nt. nt. 181-825 of SEQ ID NO: 110 |
| 111 | 5.00E−12 | putative membrane protein | *Salmonella enterica* subsp. *enterica* serovar Typhi | NP_458664.1 | compliment of nt. 45-287 of SEQ ID NO: 111 |
| 111 | 6.00E−41 | hypothetical protein | *Salmonella enterica* subsp. | NP_458658.1 | compliment of nt. 1091-1480 of |

TABLE 3A-continued

| Contig | E score | Hit Identity | Organism | Genbank Protein | SEQ ID NO: |
|---|---|---|---|---|---|
| | | | enterica serovar Typhi | | SEQ ID NO: 111 |
| 114 | 7.00E−80 | unknown | Pasteurella multocida | NP_245828.1 | compliment of nt. 118-696 of SEQ ID NO: 114 |
| 115 | 2.00E−09 | A111R | Paramecium bursaria Chlorella virus 1 | NP_048459.1 | nt. 555-869 of SEQ ID NO: 115 |
| 118 | 5.00E−45 | DNA methylase HsdM, putative | Vibrio cholerae | NP_231404.1 | nt. 44-439 of SEQ ID NO: 118 |
| 122 | 2.00E−18 | unknown | Pasteurella multocida | NP_245314.1 | nt. 865-1302 of SEQ ID NO: 122 |
| 123 | 4.00E−99 | RNA POLYMERASE SIGMA-32 FACTOR | Proteus mirabilis | P50509 | nt. 351-782 of SEQ ID NO: 123 |
| 124 | 9.00E−58 | ACETOLACTATE SYNTHASE (ACETOHYDROXY-ACID SYNTHASE) (ALS) | Spirulina platensis | P27868 | nt. 603-1025 of SEQ ID NO: 124 |
| 130 | 0 | restriction modification system-R protein | Neisseria meningitidis | CAA09003.1 | nt. 495-1559 of SEQ ID NO: 130 |
| 131 | 6.00E−91 | uronate isomerase (glucuronate isomerase) | Salmonella enterica subsp. enterica serovar Typhi | NP_457532.1 | compliment of nt. 661-1380 of SEQ ID NO: 131 |
| 133 | 3.00E−30 | GyrA | Pasteurella multocida | NP_245778.1 | compliment of nt. 1447-1626 of SEQ ID NO: 133 |
| 133 | 1.00E−27 | DNA GYRASE SUBUNIT A | Pectobacterium carotovorum | P41513 | compliment of nt. 1302-1442 of SEQ ID NO: 133 |
| 138 | 7.00E−06 | KicA | Pasteurella multocida | NP_245545.1 | compliment of nt. 92-157 of SEQ ID NO: 138 |
| 138 | 1.00E−148 | TYPE II RESTRICTION ENZYME HAEII (ENDONUCLEASE HAEII) (R. HAEII) | Haemophilus aegyptius | O30869 | compliment of nt. 164-1045 of SEQ ID NO: 138 |
| 143 | 4.00E−06 | Gifsy-1 prophage protein | Salmonella typhimurium LT2 | NP_461555.1 | compliment of nt. 228-632 of SEQ ID NO: 143 |
| 143 | 1.00E−14 | hypothetical protein | Bacteriophage VT2-Sa | NP_050531.1 | compliment of nt. 778-1248 of SEQ ID NO: 143 |
| 143 | 5.00E−09 | hypothetical protein | Salmonella enterica subsp. enterica serovar Typhi | CAD09979.1 | compliment of nt. 715-1026 of SEQ ID NO: 143 |
| 143 | 6.00E−10 | hypothetical 14.9 kd protein | Escherichia coli | NP_065324.1 | nt. 3-173 of SEQ ID NO: 143 |
| 147 | 1.00E−38 | GTP-binding elongation factor, may be inner membrane protein | Escherichia coli O157:H7 EDL933 | NP_289127.1 | compliment of nt. 172-342 of SEQ ID NO: 147 |
| 147 | 2.00E−14 | GTP-binding membrane protein (IepA) | Borrelia burgdorferi | NP_212222.1 | compliment of nt. 17-181 of SEQ ID NO: 147 |
| 148 | 6.00E−17 | galactokinase | Homo sapiens | AAC35849.1 | compliment of nt. 746-1246 of SEQ ID NO: 148 |
| 148 | 7.00E−96 | GALACTOKINASE (GALACTOSE KINASE) | Actinobacillus pleuropneumoniae | P94169 | compliment of nt. 232-741 of SEQ ID NO: 148 |
| 149 | 1.00E−92 | GTP-binding protein TypA/BipA | Buchnera sp. APS | NP_240245.1 | compliment of nt. 265-1077 of SEQ ID NO: 149 |
| 15 | 2.00E−21 | ORF 1 | Escherichia coli | CAA39631.1 | nt. 665-850 of SEQ ID NO: 15 |
| 150 | 6.00E−17 | unknown | Pasteurella multocida | NP_245919.1 | nt. 171-665 of SEQ ID NO: 150 |
| 153 | 7.00E−07 | outer membrane protein A | Rickettsia conorii | T30852 | nt. 51-623 of SEQ ID NO: 153 |

TABLE 3A-continued

| Contig | E score | Hit Identity | Organism | Genbank Protein | SEQ ID NO: |
|---|---|---|---|---|---|
| 155 | 7.00E−40 | cytochrome d ubiquinol oxidase, subunit II | Vibrio cholerae | NP_233259.1 | nt. 583-1002 of SEQ ID NO: 155 |
| 157 | 7.00E−13 | unknown | Pasteurella multocida | NP_245490.1 | compliment of nt. 1170-1367 of SEQ ID NO: 157 |
| 157 | 2.00E−05 | glycosyl transferase | Neisseria gonorrhoeae | AAA68012.1 | nt. 85-189 of SEQ ID NO: 157 |
| 158 | 1.00E−152 | MltC | Pasteurella multocida | NP_246259.1 | compliment of nt. 36-530 of SEQ ID NO: 158 |
| 161 | 3.00E−25 | lipoprotein, putative | Vibrio cholerae | NP_230232.1 | nt. 870-1439 of SEQ ID NO: 161 |
| 163 | 9.00E−53 | chorismate synthase | Caulobacter crescentus | NP_421948.1 | nt. 1283-2029 of SEQ ID NO: 163 |
| 168 | 3.00E−13 | COPPER-TRANSPORTING ATPASE 1 (COPPER PUMP 1) | Mus musculus | Q64430 | nt. 66-995 of SEQ ID NO: 168 |
| 168 | 2.00E−22 | Cu transporting ATPase P | Homo sapiens | 2001422A | nt. 135-989 of SEQ ID NO: 168 |
| 174 | 8.00E−48 | magnesium/cobalt transport protein | Mesorhizobium loti | NP_103977.1 | nt. 918-1205 of SEQ ID NO: 174 |
| 175 | 5.00E−26 | vacB protein | Buchnera sp. APS | NP_240369.1 | compliment of nt. 1-1587 of SEQ ID NO: 175 |
| 176 | 3.00E−21 | putative ABC transport system permease protein [ | Campylobacter jejuni | NP_282774.1 | compliment of nt. 259-1089 of SEQ ID NO: 176 |
| 183 | 5.00E−29 | PROBABLE ATP SYNTHASE A CHAIN TRANSMEMBRANE PROTEIN | Ralstonia solanacearum | NP_521442.1 | compliment of nt. 42-677 of SEQ ID NO: 183 |
| 185 | 6.00E−85 | putative exported protein | Salmonella enterica subsp. enterica serovar Typhi | NP_458655.1 | compliment of nt. 162-1529 of SEQ ID NO: 185 |
| 187 | 2.00E−05 | transketolase | Homo sapiens | AAA61222.1 | nt. 709-819 of SEQ ID NO: 187 |
| 188 | 1.00E−116 | ribonuclease E | Xylella fastidiosa 9a5c | NP_299884.1 | compliment of nt. 280-1704 of SEQ ID NO: 188 |
| 192 | 1.00E−38 | ImpA | Pasteurella multocida | NP_245829.1 | nt. 35-448 of SEQ ID NO: 192 |
| 193 | 3.00E−08 | Orf80 | Enterobacteria phage 186 | NP_052285.1 | nt. 1612-1818 of SEQ ID NO: 193 |
| 193 | 1.00E−06 | holin | Haemophilus somnus | AAC45168.1 | nt. 370-576 of SEQ ID NO: 193 |
| 193 | 0.007 | unknown | Enterobacteria phage 186 | NP_052260.1 | nt. 1376-1609 of SEQ ID NO: 193 |
| 193 | 2.00E−48 | lysozyme | Haemophilus somnus | AAC45169.1 | nt. 608-1093 of SEQ ID NO: 193 |
| 199 | 4.00E−21 | unknown protein | Escherichia coli O157:H7 EDL933, prophage CP-933V | NP_288675.1 | nt. 398-778 of SEQ ID NO: 199 |
| 199 | 2.00E−49 | hypothetical protein | Bacteriophage 933W | NP_049495.1 | compliment of nt. 1907-2392 of SEQ ID NO: 199 |
| 20 | 1.00E−62 | RpL14 | Pasteurella multocida | NP_246344.1 | compliment of nt. 233-601 of SEQ ID NO: 20 |
| 200 | 2.00E−62 | hypothetical protein | Salmonella enterica subsp. enterica serovar Typhi | NP_458658.1 | compliment of nt. 431-997 of SEQ ID NO: 200 |
| 200 | 3.00E−16 | hypothetical protein | Salmonella enterica subsp. enterica serovar Typhi | NP_458657.1 | compliment of nt. 1028-1264 of SEQ ID NO: 200 |
| 201 | 2.00E−26 | TsaA | Pasteurella multocida | NP_245732.1 | compliment of nt. 1618-1809 of SEQ ID NO: 201 |

TABLE 3A-continued

| Contig | E score | Hit Identity | Organism | Genbank Protein | SEQ ID NO: |
|---|---|---|---|---|---|
| 209 | 6.00E−16 | TsaA | *Pasteurella multocida* | NP_245732.1 | compliment of nt. 2-136 of SEQ ID NO: 209 |
| 211 | 2.00E−15 | unknown | *Pasteurella multocida* | NP_245535.1 | compliment of nt. 23-211 of SEQ ID NO: 211 |
| 211 | 1.00E−70 | PUTATIVE ATPASE PROTEIN | *Ralstonia solanacearum* | NP_520082.1 | compliment of nt. 475-915 of SEQ ID NO: 211 |
| 212 | 3.00E−18 | hypothetical protein | *Escherichia coli* O157:H7 | NP_309775.1 | compliment of nt. 895-1035 of SEQ ID NO: 212 |
| 216 | 1.00E−173 | unknown | *Pasteurella multocida* | NP_245069.1 | compliment of nt. 35-1543 of SEQ ID NO: 216 |
| 217 | 9.00E−18 | diacylglycerol kinase | *Vibrio cholerae* | NP_233101.1 | nt. 2083-2208 of SEQ ID NO: 217 |
| 221 | 4.00E−34 | Tail-Specific Protease | *Chlamydia trachomatis* | NP_219953.1 | nt. 849-1421 of SEQ ID NO: 221 |
| 222 | 4.00E−23 | AGR_C_3689p | *Agrobacterium tumefaciens* str. C58 (Cereon) | NP_355005.1 | compliment of nt. 940-1305 of SEQ ID NO: 222 |
| 224 | 9.00E−19 | unknown | *Pasteurella multocida* | NP_245536.1 | nt. 15-308 of SEQ ID NO: 224 |
| 225 | 1.00E−89 | portal vector-like protein, in phage P2 [*Salmonella typhimurium* LT2] | *Salmonella typhimurium* LT2Fels-2 prophage | NP_461651.1 | nt. 31-750 of of SEQ ID NO: 225 |
| 229 | 2.00E−25 | anaerobic ribonucleotide reductase | *Salmonella typhimurium* | CAB62266.1 | nt. 1806-2108 of SEQ ID NO: 229 |
| 234 | 3.00E−08 | conserved hypothetical protein | *Xylella fastidiosa* 9a5c | NP_299850.1 | nt. 1680-2048 of SEQ ID NO: 234 |
| 234 | 1.00E−42 | Methionine sulfoxide reductase C-terminal domain related protein, YPPQ ortholog | *Clostridium acetobutylicum* | NP_348177.1 | compliment of nt. 415-654 of SEQ ID NO: 234 |
| 235 | 4.00E−16 | phage-related tail protein | *Wolbachia* endosymbiont of *Drosophila melanogaster* | AAK85310.1 | compliment of nt. 931-1929 of SEQ ID NO: 235 |
| 235 | 6.00E−56 | similar to orfG protein in phage 186, *Salmonella typhimurium* LT2 | *Salmonella typhimurium* LT2, Fels-2 prophage | NP_461625.1 | compliment of nt. 313-1863 of SEQ ID NO: 235 |
| 236 | 6.00E−20 | conserved hypothetical protein | *Pseudomonas aeruginosa* | NP_252693.1 | nt. 1572-1916 of SEQ ID NO: 236 |
| 240 | 5.00E−27 | MODIFICATION METHYLASE BEPI | *Brevibacterium epidermidis* | P10283 | compliment of nt. 922-1305 of SEQ ID NO: 240 |
| 241 | 2.00E−15 | phage-related protein | *Xylella fastidiosa* 9a5c | NP_299573.1 | compliment of nt. 865-1305 of SEQ ID NO: 241 |
| 241 | 4.00E−08 | hypothetical protein | phage SPP1 | T42296 | nt. 73-636 of SEQ ID NO: 241 |
| 241 | 4.00E−07 | hypothetical protein | *Salmonella enterica* subsp. *enterica* serovar Typhi | NP_458686.1 | nt. 10-468 of SEQ ID NO: 241 |
| 242 | 2.00E−29 | translation elongation factor EF-G | chloroplast-soybean | S35701 | compliment of nt. 18-1085 of SEQ ID NO: 242 |
| 247 | 3.00E−23 | GTP CYCLOHYDROLASE I (GTP-CH-I) | *Synechococcus* sp. PCC 7942 | Q54769 | compliment of nt. 1009-1257c of SEQ ID NO: 247 |
| 248 | 6.00E−05 | phospho-N-acetylmuramoyl-pentapeptide-transferase | *Aquifex aeolicus* | NP_213025.1 | nt. 830-1747 of SEQ ID NO: 248 |
| 25 | 2.00E−86 | PROBABLE TRANSPORT TRANSMEMBRANE PROTEIN | *Ralstonia solanacearum* | NP_522358.1 | compliment of nt. 309-854 of SEQ ID NO: 25 |

TABLE 3A-continued

| Contig | E score | Hit Identity | Organism | Genbank Protein | SEQ ID NO: |
|---|---|---|---|---|---|
| 25 | 7.00E−06 | major facilitator family transporter | *Caulobacter crescentus* | NP_419155.1 | compliment of nt. 134-283 of SEQ ID NO: 25 |
| 250 | 1.00E−150 | CpdB | *Pasteurella multocida* | NP_246953.1 | compliment of nt. 36-1016 of SEQ ID NO: 250 |
| 252 | 3.00E−57 | alanyl-tRNA synthetase | *Vibrio cholerae* | AAA99922.1 | compliment of nt. 1418-1951 of SEQ ID NO: 252 |
| 253 | 1.00E−108 | similar to glutathione Reductase | *Listeria monocytogenes* EGD-e | NP_464432.1 | compliment of nt. 411-1358 of of SEQ ID NO: 253 |
| 259 | 3.00E−39 | hypothetical protein | *Salmonella enterica* subsp. *enterica* serovar *Typhi* | NP_458654.1 | compliment of nt. 342-1037 of SEQ ID NO: 259 |
| 259 | 3.00E−17 | possible exported protein | *Salmonella enterica* subsp. *enterica* serovar *Typhi* | NP_458653.1 | compliment of nt. 1251-1607 of SEQ ID NO: 259 |
| 261 | 5.00E−74 | hypothetical protein 6-Haemophilus influenzae | *Haemophilus influenzae* | S27582 | compliment of nt. 3-422 of SEQ ID NO: 261 |
| 263 | 1.00E−94 | putative transposase | *Haemophilus paragallinarum* | AAD01406.1 | nt. 2142-2672 of SEQ ID NO: 263 |
| 264 | 1.00E−126 | unknown | *Actinobacillus actinomycetemcomitans* | NP_067554.1 | nt. 40-714 of SEQ ID NO: 264 |
| 264 | 1.00E−103 | unknown | *Actinobacillus actinomycetemcomitans* | NP_067555.1 | nt. 695-1309 of SEQ ID NO: 264 |
| 264 | 2.00E−21 | unknown | *Actinobacillus actinomycetemcomitans* | NP_067556.1 | nt. 1302-1448 of SEQ ID NO: 264 |
| 265 | 6.00E−27 | Aminopeptidase 2 | chloroplast | Q42876 | nt. 556-1539 of SEQ ID NO: 265 |
| 268 | 1.00E−116 | MutY | *Pasteurella multocida* | NP_246257.1 | nt. 1003-1581 of SEQ ID NO: 268 |
| 272 | 1.00E−07 | hypothetical protein | Bacteriophage 933W | NP_049495.1 | compliment of nt. 77-232 of SEQ ID NO: 272 |
| 274 | 3.00E−13 | unknown | *Pasteurella multocida* | NP_246952.1 | compliment of nt. 1658-1975 of SEQ ID NO: 274 |
| 275 | 3.00E−20 | CafA | *Neisseria gonorrhoeae* | AAG24267.1 | nt. 1299-1571 of SEQ ID NO: 275 |
| 276 | 1.00E−45 | mukE protein | *Vibrio cholerae* | NP_231351.1 | compliment of nt. 650-1390 of SEQ ID NO: 276 |
| 276 | 1.00E−69 | KicA | *Pasteurella multocida* | NP_245545.1 | compliment of nt. 647-1321 of SEQ ID NO: 276 |
| 278 | 2.00E−56 | 3-oxoacyl-[acyl-carrier-protein] synthase III | *Salmonella enterica* subsp. *enterica* serovar *Typhi* | NP_455686.1 | nt. 1366-1944 of SEQ ID NO: 278 |
| 281 | 5.00E−56 | unknown | *Pasteurella multocida* | NP_246261.1 | compliment of nt. 31-678 of SEQ ID NO: 281 |
| 282 | 3.00E−09 | orf25; similar to T gene of P2 | bacteriophage phi CTX | NP_490625.1 | compliment of nt. 511-1032 of SEQ ID NO: 282 |
| 282 | 1.00E−08 | orf11; similar to phage P2 gene S-like product, which is involved in tail synthesis, | *Haemophilus somnus* | AAC45165.1 | compliment of nt. 1450-1584 of SEQ ID NO: 282 |
| 282 | 9.00E−27 | putative bacteriophage tail protein | *Salmonella enterica* subsp. *enterica* serovar *Typhi* | NP_457167.1 | compliment of nt. 3-509 of SEQ ID NO: 282 |
| 286 | 5.00E−18 | plasmid-related protein | *Listeria innocua* plasmid | NP_471066.1 | compliment of nt. 887-1501 of SEQ ID NO: 286 |

TABLE 3A-continued

| Contig | E score | Hit Identity | Organism | Genbank Protein | SEQ ID NO: |
|---|---|---|---|---|---|
| 287 | 8.00E−20 | GTP cyclohydrolase II | Escherichia coli O157:H7 EDL933 | NP_287920.1 | nt. 2-145 of SEQ ID NO: 287 |
| 289 | 1.00E−168 | MODIFICATION METHYLASE HAEII | Haemophilus aegyptius | O30868 | compliment of nt. 138-1091 of SEQ ID NO: 289 |
| 289 | 5.00E−11 | TYPE II RESTRICTION ENZYME HAEII | Haemophilus aegyptius | O30869 | compliment of nt. 22-132 of SEQ ID NO: 289 |
| 289 | 6.00E−47 | mukF homolog | Haemophilus influenzae biotype aegyptius | AAB70828.1 | compliment of nt. 1107-1385 of SEQ ID NO: 289 |
| 294 | 1.00E−171 | LICA PROTEIN | Haemophilus influenzae RM7004 | P14181 | compliment of nt. 677-1564 of SEQ ID NO: 294 |
| 297 | 1.00E−158 | DNA methylase HsdM, putative | Vibrio cholerae | NP_231404.1 | compliment of nt. 12-1136 of SEQ ID NO: 297 |
| 302 | 0 | HEME-BINDING PROTEIN A | Haemophilus influenzae DL42 | P33950 | nt. 3-1316 of SEQ ID NO: 302 |
| 304 | 6.00E−19 | hypothetical protein 6 | Haemophilus influenzae | S27582 | nt. 121-267 of SEQ ID NO: 304 |
| 305 | 6.00E−40 | putative recombinase-phage associated | Streptococcus pyogenes M1 GAS | NP_269557.1 | nt. 65-805 of SEQ ID NO: 305 |
| 305 | 7.00E−22 | single stranded DNA-binding protein | Shewanella sp. F1A | AAB57886.1 | nt. 1607-2014 of SEQ ID NO: 305 |
| 305 | 1.00E−43 | phage-related protein | Bacillus halodurans | NP_244410.1 | nt. 92-751 of SEQ ID NO: 305 |
| 312 | 1.00E−28 | PUTATIVE BACTERIOPHAGE-RELATED TRANSMEMBRANE PROTEIN | Ralstonia solanacearum | NP_518994.1 | nt. 1819-2673 of SEQ ID NO: 312 |
| 312 | 9.00E−25 | similar to BASEMENT MEMBRANE-SPECIFIC HEPARAN SULFATE PROTEOGLYCAN CORE PROTEIN PRECURSOR (HSPG) | Homo sapiens | XP_068727.1 | nt. 27-1001 of SEQ ID NO: 312 |
| 315 | 2.00E−45 | uracil permease | Deinococcus radiodurans | NP_296001.1 | compliment of nt. 525-1592 of SEQ ID NO: 315 |
| 318 | 7.00E−15 | CzcD | Pasteurella multocida | NP_246276.1 | compliment of nt. 3-227 of SEQ ID NO: 318 |
| 320 | 2.00E−60 | orf3; similar to endonuclease subunit of the phage P2 terminase (gene M) | Haemophilus somnus | AAC45159.1 | compliment of nt. 606-1241 of SEQ ID NO: 320 |
| 320 | 2.00E−09 | orf4; similar to head completion/stabilization protein (gene L) of phage P2 | Haemophilus somnus | AAC45160.1 | compliment of nt. 52-285 of SEQ ID NO: 320 |
| 320 | 3.00E−35 | orf2; similar to major capsid protein precursor of phage P2 (gene N) | Haemophilus somnus | AAC45158.1 | compliment of nt. 1271-1624 of SEQ ID NO: 320 |
| 323 | 4.00E−37 | dedC protein | Escherichia coli | AAA23966.1 | compliment of nt. 74-463 of SEQ ID NO: 323 |
| 324 | 1.00E−153 | conserved hypothetical protein | Neisseria meningitidis MC58 | NP_274972.1 | compliment of nt. 930-1943 of SEQ ID NO: 324 |
| 326 | 5.00E−52 | selenophosphate synthetase | Eubacterium acidaminophilum | CAB53511.1 | compliment of nt. 1186-2292 of SEQ ID NO: 326 |

TABLE 3A-continued

| Contig | E score | Hit Identity | Organism | Genbank Protein | SEQ ID NO: |
|---|---|---|---|---|---|
| 328 | 1.00E−129 | secretion protein SecD | Pseudomonas aeruginosa | NP_252510.1 | compliment of nt. 8-625 of SEQ ID NO: 328 |
| 333 | 3.00E−08 | unknown | Pasteurella multocida | NP_245489.1 | compliment of nt. 5-418 of SEQ ID NO: 333 |
| 336 | 6.00E−38 | probable methyl transferase | Pseudomonas aeruginosa | NP_253353.1 | compliment of nt. 2547-2819 of SEQ ID NO: 336 |
| 338 | 2.00E−98 | Pmi | Pasteurella multocida | NP_245766.1 | nt. 144-842 of SEQ ID NO: 338 |
| 339 | 2.00E−07 | tRNA nucleotidyltransferase | Escherichia coli | QQECPE | nt. 2331-2540 of SEQ ID NO: 339 |
| 340 | 0 | DNA gyrase, subunit A, type II topoisomerase | Salmonella typhimurium LT2 | NP_461214.1 | compliment of nt. 93-1799 of SEQ ID NO: 340 |
| 342 | 4.00E−12 | tolA protein | Haemophilus influenzae | JC5212 | nt. 980-1318 of SEQ ID NO: 342 |
| 344 | 1.00E−07 | MODIFICATION METHYLASE HPHIA | Haemophilus parahaemolyticus | P50192 | compliment of nt. 849-1034 of SEQ ID NO: 344 |
| 344 | 8.00E−05 | ABC transporter protein 1 | Leishmania major | AAF31030.1 | compliment of nt. 17-205 of SEQ ID NO: 344 |
| 349 | 3.00E−44 | conserved hypothetical protein | Neisseria meningitidis MC58 | NP_273467.1 | compliment of nt. 1397-1903 of SEQ ID NO: 349 |
| 349 | 8.00E−09 | hypothetical protein | Pseudomonas aeruginosa | NP_252667.1 | compliment of nt. 795-1121 of SEQ ID NO: 349 |
| 349 | 9.00E−10 | conserved hypothetical secreted protein | Helicobacter pylori 26695 | NP_207009.1 | compliment of nt. 1319-1816 of SEQ ID NO: 349 |
| 349 | 2.00E−06 | putative TPR repeat protein | Salmonella typhimurium LT2 | NP_463149.1 | compliment of nt. 2244-2558 of SEQ ID NO: 349 |
| 35 | 1.00E−23 | type I restriction-modification system specificity determinant | Xylella fastidiosa 9a5c | NP_300003.1 | compliment of nt. 29-388 of SEQ ID NO: 35 |
| 352 | 1.00E−116 | putative peptidase | Escherichia coli K12 | NP_416827.1 | compliment of nt. 951-1640 of SEQ ID NO: 352 |
| 352 | 0 | unknown | Pasteurella multocida | NP_245275.1 | compliment of nt. 86-946 of SEQ ID NO: 352 |
| 354 | 5.00E−86 | putative uronate isomerase | Salmonella typhimurium LT2 | NP_462052.1 | compliment of nt. 168-914 of SEQ ID NO: 354 |
| 356 | 1.00E−07 | isomerase-like protein (DsbD)- | Escherichia coli | S57220 | nt. 5-73 of SEQ ID NO: 356 |
| 358 | 1.00E−07 | USG protein | Pediococcus pentosaceus | CAC16793.1 | nt. 534-1307 of SEQ ID NO: 358 |
| 358 | 0.005 | HsdS protein | Escherichia coli | CAA10700.1 | nt. 26-205 of SEQ ID NO: 358 |
| 361 | 1.00E−152 | maltodextrin phosphorylase | Escherichia coli O157:H7 EDL933 | NP_289957.1 | compliment of nt. 77-922 of SEQ ID NO: 361 |
| 363 | 6.00E−06 | BH2505-unknown conserved protein | Bacillus halodurans | NP_243371.1 | nt. 554-844 of SEQ ID NO: 363 |
| 368 | 1.00E−12 | H02F09.3.p | Caenorhabditis elegans | NP_508295.1 | compliment of nt. 1069-1977 of SEQ ID NO: 368 |
| 368 | 6.00E−27 | hypothetical glycine-rich protein | Mesorhizobium loti | NP_102360.1 | compliment of nt. 1201-1986 of SEQ ID NO: 368 |
| 37 | 6.00E−09 | putative ATP-binding component of a transport system | Escherichia coli K12 | NP_415469.1 | compliment of nt. 455-691 of SEQ ID NO: 37 |
| 372 | 7.00E−18 | conserved hypothetical protein | Clostridium perfringens | BAB80319.1 | compliment of nt. 1763-1924 of SEQ ID NO: 372 |

TABLE 3A-continued

| Contig | E score | Hit Identity | Organism | Genbank Protein | SEQ ID NO: |
|---|---|---|---|---|---|
| 376 | 7.00E−24 | putative bacteriophage protein | Salmonella enterica subsp. enterica serovar Typhi | NP_456379.1 | compliment of nt. 158-808 of SEQ ID NO: 376 |
| 376 | 8.00E−10 | hypothetical protein | Xylella fastidiosa 9a5c | NP_298882.1 | compliment of nt. 1129-1671 of SEQ ID NO: 376 |
| 376 | 9.00E−06 | lin1713 | Listeria innocua | NP_471049.1 | compliment of nt 913-1557 of SEQ ID NO: 376 |
| 377 | 6.00E−05 | Vng1732c | Halobacterium sp. NRC-1 | NP_280487.1 | nt. 2378-2587 of SEQ ID NO: 377 |
| 377 | 1.00E−11 | INVASIN PRECURSOR (OUTER MEMBRANE ADHESIN) | Yersinia enterocolitica | P31489 | compliment of nt. 127-345 of SEQ ID NO: 377 |
| 382 | 4.00E−16 | unknown | Pasteurella multocida | NP_246871.1 | compliment of nt. 967-1068 of SEQ ID NO: 382 |
| 383 | 4.00E−36 | putative transposase | Streptomyces avermitilis | BAB69302.1 | nt. 488-1162 of SEQ ID NO: 383 |
| 383 | 3.00E−58 | recombinase | IncN plasmid R46 | NP_511241.1 | compliment of nt. 1-393 of SEQ ID NO: 383 |
| 383 | 4.00E−24 | transposase | Escherichia coli | I69674 | nt. 1294-1740 of SEQ ID NO: 383 |
| 383 | 0 | tnpA | Yersinia enterocolitica | CAA73750.1 | nt. 1782-2834 of SEQ ID NO: 383 |
| 385 | 2.00E−31 | unknown | Pasteurella multocida | NP_246065.1 | nt. 1515-1772 of SEQ ID NO: 385 |
| 386 | 5.00E−65 | cydC [ | Escherichia coli | AAA66172.1 | compliment of nt. 3438-4115 of SEQ ID NO: 386 |
| 386 | 4.00E−33 | ABC transporter, ATP-binding protein | Mesorhizobium loti | NP_105463.1 | compliment of nt. 2569-3390 of SEQ ID NO: 386 |
| 388 | 3.00E−45 | 60 KDA INNER-MEMBRANE PROTEIN HOMOLOG | Coxiella burnetii | P45650 | compliment of nt. 3211-3759 of SEQ ID NO: 388 |
| 390 | 4.00E−25 | putative DNA-binding protein | Salmonella enterica subsp. enterica serovar Typhi | NP_458175.1 | nt. 1051-1416 of SEQ ID NO: 390 |
| 390 | 3.00E−13 | transcriptional regulator | Bacillus halodurans | NP_241773.1 | compliment of nt. 84-578 of SEQ ID NO: 390 |
| 390 | 3.00E−06 | DNA translocase stage III sporulation prot homolog | Staphylococcus aureus subsp. aureus Mu50 | NP_372265.1 | compliment of nt. 620-871 of SEQ ID NO: 390 |
| 395 | 7.00E−31 | ATPase, Cu++ transporting, beta polypeptide | Homo sapiens | NP_000044.1 | compliment of nt. 615-1406 of SEQ ID NO: 395 |
| 397 | 3.00E−23 | terminase large subunit | Bacteriophage HK620 | NP_112076.1 | compliment of nt. 2363-2725 of SEQ ID NO: 397 |
| 397 | 3.00E−16 | hypothetical protein | Xylella fastidiosa 9a5c | NP_297824.1 | compliment of nt. 1517-1744 of SEQ ID NO: 397 |
| 398 | 4.00E−67 | orf32 | Haemophilus phage HP2 | NP_536839.1 | compliment of nt. 1288-1866 of SEQ ID NO: 398 |
| 398 | 8.00E−24 | putative cytoplasmic protein | Salmonella typhimurium LT2 | NP_463063.1 | compliment of nt. 798-1220 of SEQ ID NO: 398 |
| 398 | 2.00E−83 | orf31 | Haemophilus phage HP1 | NP_043502.1 | compliment of nt. 1881-2510 of SEQ ID NO: 398 |
| 399 | 1.00E−94 | HEME/HEMOPEXIN-BINDING PROTEIN | Haemophilus influenzae N182 | P45355 | nt. 88-774 of SEQ ID NO: 399 |
| 401 | 3.00E−63 | Sty SBLI | Salmonella enterica | CAA68058.1 | nt. 1690-2742 of SEQ ID NO: 401 |

TABLE 3A-continued

| Contig | E score | Hit Identity | Organism | Genbank Protein | SEQ ID NO: |
|---|---|---|---|---|---|
| 401 | 3.00E−06 | RESTRICTION-MODIFICATION ENZYME SUBUNIT M3 | *Mycoplasma pulmonis* | NP_325912.1 | nt. 79-489 of SEQ ID NO: 401 |
| 402 | 2.00E−13 | OPACITY PROTEIN OPA66 PRECURSOR | *Neisseria gonorrhoeae* | Q05033 | compliment of nt. 2634-2915 of SEQ ID NO: 402 |
| 406 | 8.00E−13 | type I restriction enzyme EcoR124IIR | *Neisseria meningitidis* MC58 | NP_273876.1 | nt. 281-520 of SEQ ID NO: 406 |
| 407 | 6.00E−65 | unknown | *Pasteurella multocida* | NP_246237.1 | nt. 938-2450 of SEQ ID NO: 407 |
| 407 | 5.00E−99 | PepE | *Pasteurella multocida* | NP_245391.1 | nt. 1216-1917 of SEQ ID NO: 407 |
| 407 | 1.00E−16 | Hemoglobin-haptoglobin binding protein A | *Haemophilus influenzae* Tn106 | Q48153 | nt. 1-141 of SEQ ID NO: 407 |
| 409 | 1.00E−106 | hypothetical protein 1 | *Haemophilus influenzae* | S27577 | compliment of nt. 2524-3159 of SEQ ID NO: 409 |
| 411 | 4.00E−29 | heme-repressible hemoglobin-binding protein | *Haemophilus influenzae*, type b, strain HI689 | AAB46794.1 | nt. 391-615 of SEQ ID NO: 411 |
| 411 | 0 | Hemoglobin-haptoglobin binding protein A | *Haemophilus influenzae* Tn106 | Q48153 | nt. 651-3263 of SEQ ID NO: 411 |
| 412 | 2.00E−07 | REGULATORY PROTEIN CRO (ANTIREPRESSOR) | bacteriophage 434 | P03036 | compliment of nt. 59-259 of SEQ ID NO: 412 |
| 412 | 4.00E−06 | hypothetical protein | Bacteriophage P27 | CAC83535.1 | nt. 1436-1654 of SEQ ID NO: 412 |
| 413 | 8.00E−07 | hypothetical protein | *Deinococcus radiodurans* | NP_294301.1 | compliment of nt. 791-1012 of SEQ ID NO: 413 |
| 414 | 9.00E−65 | conserved hypothetical protein | *Vibrio cholerae* | NP_230092.1 | nt. 1696-2103 of SEQ ID NO: 414 |
| 414 | 3.00E−93 | unknown | *Pasteurella multocida* | NP_246834.1 | nt. 1777-2109 of SEQ ID NO: 414 |
| 416 | 2.00E−17 | unknown | *Pasteurella multocida* | NP_246629.1 | compliment of nt. 2565-2831 of SEQ ID NO: 416 |
| 416 | 4.00E−26 | hypothetical protein o154 | *Escherichia coli* | S30728 | compliment of nt. 1928-2254 of SEQ ID NO: 416 |
| 416 | 3.00E−37 | transport protein TatC | *Pseudomonas aeruginosa* | NP_253757.1 | compliment of nt. 1494-2018 of of SEQ ID NO: 416 |
| 417 | 1.00E−66 | weakly similar to methyltransferases | *Listeria innocua* | NP_471073.1 | compliment of nt. 999-1928 of SEQ ID NO: 417 |
| 417 | 5.00E−05 | DNA-BINDING PROTEIN RDGA | *Pectobacterium carotovorum* | Q47587 | compliment of nt. 3526-4212 of SEQ ID NO: 417 |
| 417 | 2.00E−29 | putative phage-related protein | *Yersinia pestis* | NP_407132.1 | compliment of nt. 2546-2938 of SEQ ID NO: 417 |
| 417 | 3.00E−06 | Adenine-specific DNA methylase | *Thermoplasma acidophilum* | NP_393798.1 | compliment of nt. 826-1020 of SEQ ID NO: 417 |
| 43 | 9.00E−16 | PcnB | *Pasteurella multocida* | NP_245801.1 | nt. 511-870 of SEQ ID NO: 43 |
| 434 | 2.00E−97 | beta' subunit of RNA polymerase | *Nephroselmis olivacea* | NP_050840.1 | compliment of nt. 32-1534 of SEQ ID NO: 434 |
| 435 | 4.00E−52 | MODIFICATION METHYLASE BEPI | *Brevibacterium epidermidis* | P10283 | compliment of nt. 11-565 of SEQ ID NO: 435 |
| 435 | 4.00E−57 | pentafunctional arom polypeptide (contains: 3-dehydroquinate synthase, 3-dehydroquinate dehydratase (3-dehydroquinase), | *Saccharomyces cerevisiae* | NP_010412.1 | compliment of nt. 757-2064 of SEQ ID NO: 435 |

TABLE 3A-continued

| Contig | E score | Hit Identity | Organism | Genbank Protein | SEQ ID NO: |
|---|---|---|---|---|---|
| 437 | 5.00E−70 | shikimate 5-dehydrogenase, shikimate kinase, and epsp synthase dihydrofolate reductase | *Haemophilus influenzae* (clinical isolate R1042) | S52336 | nt. 2393-2767 of SEQ ID NO: 437 |
| 438 | 1.00E−106 | polyA polymerase | *Vibrio cholerae* | NP_230244.1 | nt. 3-1124 of SEQ ID NO: 438 |
| 439 | 6.00E−60 | Porphyrin biosynthetic protein | *Salmonella enterica* subsp. *enterica* serovar Typhi | NP_457816.1 | nt. 2343-2783 of SEQ ID NO: 439 |
| 441 | 5.00E−73 | RimM | *Pasteurella multocida* | NP_246234.1 | compliment of nt. 151-441 of SEQ ID NO: 441 |
| 442 | 9.00E−31 | LIPOPROTEIN NLPD | *Salmonella typhimurium* | P40827 | compliment of nt. 3362-3520 of SEQ ID NO: 442 |
| 444 | 6.00E−24 | glycine betaine transporter | *Staphylococcus aureus* subsp. *aureus* Mu50 | NP_371872.1 | compliment of nt. 2242-2514 of SEQ ID NO: 444 |
| 452 | 6.00E−28 | unknown | *Pasteurella multocida* | NP_245616.1 | compliment of nt. 533-883 of SEQ ID NO: 452 |
| 452 | 0 | Type I restriction enzyme Ecoprrl M protein | *Escherichia coli* | Q47163 | nt. 3291-4154 of SEQ ID NO: 452 |
| 452 | 2.00E−75 | type I restriction enzyme M protein | *Ureaplasma urealyticum* | NP_077929.1 | nt. 4156-4562 of SEQ ID NO: 452 |
| 455 | 9.00E−56 | PROBABLE BACTERIOPHAGE PROTEIN | *Ralstonia solanacearum* | NP_520059.1 | nt. 2028-2774 of SEQ ID NO: 455 |
| 455 | 2.00E−55 | orf2; similar to major capsid protein precursor of phage P2 (gene N), | *Haemophilus somnus* | AAC45158.1 | nt. 2864-3490 of SEQ ID NO: 455 |
| 455 | 1.00E−175 | gpP | Enterobacteria phage P2 | NP_046758.1 | compliment of nt. 127-1812 of SEQ ID NO: 455 |
| 456 | 1.00E−38 | hypothetical protein | *Pseudomonas putida* | NP_542872.1 | compliment of nt. 1010-1282 of SEQ ID NO: 456 |
| 456 | 1.00E−172 | hypothetical protein | *Pseudomonas putida* | NP_542873.1 | compliment of nt. 1443-2006 of SEQ ID NO: 546 |
| 457 | 1.00E−116 | hypothetical protein (galE 5' region)-*Haemophilus influenzae* | *Haemophilus influenzae* | S15287 | compliment of nt. 62-961 of SEQ ID NO: 457 |
| 457 | 1.00E−134 | dTDPglucose 4,6-dehydratase | *Actinobacillus actinomycetemcomitans* | T00102 | nt. 2637-3656 of SEQ ID NO: 457 |
| 459 | 2.00E−10 | RNA polymerase gamma-subunit | *Synechocystis* sp. PCC 6803 | NP_441586.1 | nt. 25-117 of SEQ ID NO: 459 |
| 461 | 9.00E−51 | conserved hypothetical protein | *Staphylococcus aureus* subsp. *aureus* Mu50 | NP_370593.1 | nt. 4124-4624 of SEQ ID NO: 461 |
| 462 | 9.00E−06 | NADH dehydrogenase | *Burkholderia pseudomallei* | AAG01016.1 | nt. 703-828 of SEQ ID NO: 462 |
| 465 | 3.00E−41 | GTP-binding protein Era | *Synechocystis* sp. PCC 6803 | NP_441951.1 | compliment of nt. 2470-2787 of SEQ ID NO: 465 |
| 466 | 1.00E−15 | putative bacteriophage protein | *Salmonella enterica* subsp. *enterica* serovar Typhi | NP_455548.1 | nt. 837-1478 of SEQ ID NO: 466 |
| 466 | 1.00E−90 | orf31 | *Haemophilus* phage HP1 | NP_043502.1 | nt. 2396-3199 of SEQ ID NO: 466 |
| 469 | 0 | Hemoglobin and hemoglobin-haptoglobin binding protein C precursor | *Haemophilus influenzae* HI689 | Q9X442 | compliment of nt. 427-3459 of SEQ ID NO: 469 |

TABLE 3A-continued

| Contig | E score | Hit Identity | Organism | Genbank Protein | SEQ ID NO: |
|---|---|---|---|---|---|
| 471 | 8.00E−05 | transposase, putative | Neisseria meningitidis MC58 | NP_274608.1 | nt. 2957-3217 of SEQ ID NO: 471 |
| 472 | 6.00E−08 | hypothetical protein | Salmonella enterica subsp. enterica serovar Typhi | NP_458660.1 | compliment of nt. 2881-3270 of SEQ ID NO: 472 |
| 472 | 5.00E−23 | antirestriction protein | Mesorhizobium loti | NP_106707.1 | nt. 4908-5324 of SEQ ID NO: 472 |
| 472 | 1.00E−75 | hypothetical protein | Salmonella enterica subsp. enterica serovar Typhi | NP_458661.1 | compliment of nt. 1931-2776 of SEQ ID NO: 472 |
| 472 | 9.00E−72 | hypothetical protein | Salmonella enterica subsp. enterica serovar Typhi | NP_458662.1 | compliment of nt. 544-1689 of SEQ ID NO: 472 |
| 475 | 3.00E−25 | unknown | Pasteurella multocida | NP_244952.1 | nt. 3207-3626 of SEQ ID NO: 475 |
| 476 | 8.00E−73 | putative DNA-binding protein | Salmonella enterica subsp. enterica serovar Typhi | NP_458175.1 | compliment of nt. 3339-4310 of SEQ ID NO: 476 |
| 476 | 6.00E−47 | anticodon nuclease | Neisseria meningitidis MC58 | NP_273873.1 | compliment of nt. 4397-4885 of SEQ ID NO: 476 |
| 478 | 3.00E−06 | methionin synthase-like enzyme | Arabidopsis thaliana | CAB38313.1 | compliment of nt. 3554-3679 of SEQ ID NO: 478 |
| 478 | 3.00E−05 | unknown | Pasteurella multocida | NP_245444.1 | compliment of nt. 164-250 of SEQ ID NO: 478 |
| 479 | 1.00E−18 | conserved hypothetical protein | Xylella fastidiosa 9a5c | NP_298841.1 | nt. 2302-2658 of SEQ ID NO: 479 |
| 48 | 3.00E−19 | Dca | Neisseria gonorrhoeae | AAF12796.1 | compliment of nt. 225-746 of SEQ ID NO: 48 |
| 482 | 1.00E−06 | hypothetical protein | Neisseria meningitidis MC58 | NP_275122.1 | nt. 2055-2189 of SEQ ID NO: 482 |
| 482 | 9.00E−28 | conserved hypothetical protein | Neisseria meningitidis MC58 | NP_274383.1 | nt. 1689-1898 of SEQ ID NO: 482 |
| 487 | 5.00E−75 | conserved hypothetical protein | Neisseria meningitidis Z2491 | NP_284304.1 | nt. 2541-2978 of SEQ ID NO: 487 |
| 488 | 2.00E−64 | unknown | Pasteurella multocida | NP_246617.1 | nt. 2983-3540 of SEQ ID NO: 488 |
| 488 | 8.00E−93 | 1-deoxy-D-xylulose 5-phosphate reductoisomerase | Zymomonas mobilis | AAD29659.1 | nt. 1344-1880 of SEQ ID NO: 488 |
| 491 | 5.00E−51 | rubredoxin oxidoreductase homolog | Clostridium acetobutylicum | AAB50346.1 | compliment of nt. 1690-2439 of SEQ ID NO: 491 |
| 492 | 1.00E−27 | phosphotransferase system enzyme IIA-like protein | Staphylococcus aureus | AAK83253.1 | compliment of nt. 755-970 of SEQ ID NO: 492 |
| 493 | 2.00E−84 | unknown | Actinobacillus actinomycetemcomitans | AAC70895.1 | nt. 3333-3935 of SEQ ID NO: 493 |
| 493 | 4.00E−49 | unknown | Helicobacter pylori J99 | NP_223898.1 | nt. 3345-4010 of SEQ ID NO: 493 |
| 493 | 9.00E−31 | transcriptional factor MdcH | Acinetobacter calcoaceticus | AAF20290.1 | nt. 1885-2793 of SEQ ID NO: 493 |
| 493 | 6.00E−30 | HimA | Pasteurella multocida | NP_245565.1 | nt. 1129-1260 of SEQ ID NO: 493 |
| 494 | 4.00E−85 | putative prophage integrase | Yersinia pestis | NP_404712.1 | nt. 900-2099 of SEQ ID NO: 494 |
| 494 | 4.00E−63 | DNA methyltransferase | Xylella fastidiosa 9a5c | NP_299063.1 | compliment of nt. 5544-6170 of SEQ ID NO: 494 |
| 494 | 6.00E−19 | MODIFICATION METHYLASE SCRFIA | Lactococcus lactis subsp. cremoris | P34877 | compliment of nt. 5019-6113 of SEQ ID NO: 494 |

TABLE 3A-continued

| Contig | E score | Hit Identity | Organism | Genbank Protein | SEQ ID NO: |
|---|---|---|---|---|---|
| 497 | 0 | transferrin-binding protein 1 | Haemophilus influenzae (strain PAK 12085) | S70906 | nt. 3251-4999 of SEQ ID NO: 497 |
| 50 | 5.00E−07 | AcpP | Pasteurella multocida | NP_246856.1 | nt. 2-136 of SEQ ID NO: 50 |
| 501 | 7.00E−50 | conserved hypothetical protein | Vibrio cholerae | NP_231403.1 | compliment of nt. 3649-4872 of SEQ ID NO: 501 |
| 501 | 0 | type I restriction enzyme HsdR, putative | Vibrio cholerae | NP_231400.1 | compliment of nt. 1551-3440 of SEQ ID NO: 501 |
| 501 | 4.00E−13 | ATP-dependent DNA helicase RecG-related protein | Deinococcus radiodurans | NP_295921.1 | compliment of nt. 5317-5844 of SEQ ID NO: 501 |
| 501 | 5.00E−11 | conserved hypothetical | Ureaplasma urealyticum | NP_077868.1 | compliment of nt. 5098-5769 of SEQ ID NO: 501 |
| 504 | 2.00E−44 | OUTER MEMBRANE PROTEIN P2 PRECURSOR (OMP P2) | Haemophilus influenzae AG30010 | Q48218 | compliment of nt. 4681-5019 of SEQ ID NO: 504 |
| 507 | 0 | SpoT | Pasteurella multocida | NP_245857.1 | compliment of nt. 3685-5316 of SEQ ID NO: 507 |
| 51 | 6.00E−87 | glucosamine--fructose-6-phosphate aminotransferase (isomerizing) | Vibrio cholerae | NP_230141.1 | nt. 30-470 of SEQ ID NO: 51 |
| 512 | 2.00E−28 | dipeptide transport system permease protein | Yersinia pestis | NP_407439.1 | compliment of nt. 1095-1580 of SEQ ID NO: 512 |
| 512 | 3.00E−82 | SapC | Pasteurella multocida | NP_245850.1 | compliment of nt. 730-1095 of SEQ ID NO: 512 |
| 514 | 9.00E−06 | putative integral membrane protein | Campylobacter jejuni | NP_281236.1 | compliment of nt. 577-684 of SEQ ID NO: 514 |
| 514 | 3.00E−11 | orf, hypothetical protein | Escherichia coli O157:H7 EDL933 | NP_286004.1 | compliment of nt. 449-568 of SEQ ID NO: 514 |
| 518 | 0 | putative inner membrane transacylase protein | Neisseria meningitidis Z2491 | NP_284893.1 | nt. 92-1927 of SEQ ID NO: 518 |
| 519 | 4.00E−30 | hypothetical protein | Mesorhizobium loti | NP_108196.1 | compliment of nt. 2221-3159 of SEQ ID NO: 519 |
| 519 | 2.00E−12 | conserved hypothetical protein | Listeria innocua | NP_471067.1 | compliment of nt. 3994-5241 of SEQ ID NO: 519 |
| 519 | 6.00E−20 | hypothetical protein | Mesorhizobium loti | NP_108198.1 | compliment of nt. 707-1552 of SEQ ID NO: 519 |
| 519 | 4.00E−26 | putative bacteriophage protein | Salmonella enterica subsp. enterica serovar Typhi | NP_455526.1 | compliment of nt. 3982-5163 of SEQ ID NO: 519 |
| 52 | 3.00E−94 | OUTER MEMBRANE PROTEIN P2 PRECURSOR (OMP P2) | Haemophilus influenzae | Q48218 | nt. 45-788 of SEQ ID NO: 52 |
| 520 | 0 | excision nuclease subunit A | Escherichia coli K12 | NP_418482.1 | compliment of nt. 6309-7745 of SEQ ID NO: 520 |
| 521 | 5.00E−08 | zinc/manganese ABC transporter substrate binding protein | Rickettsia conorii | NP_359651.1 | nt. 2236-2652 of SEQ ID NO: 521 |
| 521 | 1.00E−140 | unknown | Pasteurella multocida | NP_245865.1 | nt. 338-1390 of SEQ ID NO: 521 |
| 521 | 1.00E−86 | ORF_f432 | Escherichia coli | AAB40463.1 | nt. 203-1390 of SEQ ID NO: 521 |

TABLE 3A-continued

| Contig | E score | Hit Identity | Organism | Genbank Protein | SEQ ID NO: |
|---|---|---|---|---|---|
| 522 | 3.00E−22 | unknown | Pasteurella multocida | NP_246093.1 | nt. 670-885 of SEQ ID NO: 522 |
| 526 | 5.00E−33 | exodeoxyribonuclease V alpha chain | Yersinia pestis | NP_404635.1 | nt. 5582-6202 of SEQ ID NO: 526 |
| 526 | 1.00E−62 | exodeoxyribonuclease V, 67 kDa subunit | Vibrio cholerae | NP_231950.1 | nt. 5675-6193 of SEQ ID NO: 526 |
| 527 | 1.00E−147 | unknown | Pasteurella multocida | NP_245980.1 | nt. 4283-5203 of SEQ ID NO: 527 |
| 527 | 0 | Mfd | Pasteurella multocida | NP_245978.1 | nt. 7545-8759 of SEQ ID NO: 527 |
| 527 | 0 | transcription-repair coupling factor (TrcF) | Salmonella enterica subsp. enterica serovar Typhi | NP_455708.1 | nt. 7611-8762 of SEQ ID NO: 527 |
| 527 | 0 | PROBABLE TRANSCRIPTION-REPAIR COUPLING FACTOR PROTEIN | Ralstonia solanacearum | NP_519763.1 | nt. 7611-8870 of SEQ ID NO: 527 |
| 528 | 1.00E−48 | undecaprenyl pyrophosphate synthetase | Chlamydia muridarum | NP_297109.1 | nt. 2918-3712 of SEQ ID NO: 528 |
| 528 | 0 | leucyl-tRNA synthetase | Vibrio cholerae | NP_230603.1 | compliment of nt. 180-2822 of SEQ ID NO: 528 |
| 529 | 1.00E−104 | DNA PRIMASE | Legionella pneumophila | P71481 | compliment of nt. 3316-3960 of SEQ ID NO: 529 |
| 534 | 9.00E−29 | putative integrase | Salmonella typhimurium LT2 | NP_461690.1 | nt. 4668-5009 of SEQ ID NO: 534 |
| 534 | 6.00E−18 | hypothetical protein NMA0153 | Neisseria meningitidis Z2491 | NP_283002.1 | compliment of nt. 5933-6337 of SEQ ID NO: 534 |
| 534 | 2.00E−23 | hypothetical protein | Deinococcus radiodurans | NP_294868.1 | nt. 6908-7654 of SEQ ID NO: 534 |
| 534 | 1.00E−88 | prophage CP4-57 integrase | Escherichia coli K12 | NP_417111.1 | nt. 5057-5875 of SEQ ID NO: 534 |
| 535 | 1.00E−115 | phosphate acetyltransferase | Buchnera sp. APS | NP_240007.1 | nt. 3385-4596 of SEQ ID NO: 535 |
| 536 | 3.00E−35 | cobalt membrane transport protein CbiQ | Actinobacillus pleuropneumoniae | AAD49727.1 | compliment of nt. 3531-4136 of SEQ ID NO: 536 |
| 536 | 6.00E−37 | unknown | Pasteurella multocida | NP_245305.1 | compliment of nt. 6478-6921 of SEQ ID NO: 536 |
| 539 | 2.00E−26 | Orf122 | Chlorobium tepidum | AAG12204.1 | compliment of nt. 1778-2008 of SEQ ID NO: 539 |
| 540 | 1.00E−77 | heat shock protein HtpX | Neisseria meningitidis MC58 | NP_273864.1 | compliment of nt. 2567-3481 of SEQ ID NO: 540 |
| 541 | 0 | IleS | Pasteurella multocida | NP_246601.1 | nt. 3167-4549 of SEQ ID NO: 541 |
| 545 | 2.00E−09 | DNA-BINDING PROTEIN RDGB | Pectobacterium carotovorum | Q47588 | nt. 3816-3977 of SEQ ID NO: 545 |
| 545 | 2.00E−11 | putative transposase | Sinorhizobium meliloti | NP_437741.1 | compliment of nt. 2786-3019 of SEQ ID NO: 544 |
| 545 | 2.00E−07 | Hypothetical 42.5 kd protein in thrW-argF intergenic region | Escherichia coli | BAA77933.1 | compliment of nt. 2614-2811 of SEQ ID NO: 545 |
| 545 | 4.00E−18 | putative IS element transposase | Salmonella enterica subsp. enterica serovar Typhi | NP_454711.1 | nt. 1955-2230 of SEQ ID NO: 545 |
| 546 | 0 | HEME/HEMOPEXIN-BINDING PROTEIN | Haemophilus influenzae | P45354 | nt. 5551-7809 of SEQ ID NO: 546 |
| 546 | 0 | HEME/HEMOPEXIN UTILIZATION PROTEIN B | Haemophilus influenzae | P45356 | nt. 3842-5536 of SEQ ID NO: 546 |

TABLE 3A-continued

| Contig | E score | Hit Identity | Organism | Genbank Protein | SEQ ID NO: |
|---|---|---|---|---|---|
| 546 | 0 | HEME/HEMOPEXIN UTILIZATION PROTEIN C | *Haemophilus influenzae* | P45357 | nt. 1638-3176 of SEQ ID NO: 546 |
| 546 | 2.00E−12 | HasR | *Pasteurella multocida* | NP_246561.1 | nt. 3149-3763 of SEQ ID NO: 546 |
| 549 | 0 | unknown | *Pasteurella multocida* | NP_246821.1 | nt. 2526-3512 of SEQ ID NO: 549 |
| 549 | 1.00E−121 | putative membrane protein | *Yersinia pestis* | NP_404859.1 | nt. 605-1108 of SEQ ID NO: 549 |
| 549 | 0 | unknown | *Pasteurella multocida* | NP_246822.1 | nt. 1122-1664 of SEQ ID NO: 549 |
| 551 | 1.00E−157 | type I restriction-modification system endonuclease | *Xylella fastidiosa* 9a5c | NP_300016.1 | compliment of nt. 7396-8322 of SEQ ID NO: 551 |
| 552 | 1.00E−100 | valyl-tRNA synthetase | *Deinococcus radiodurans* | NP_293872.1 | compliment of nt. 6691-8688 of SEQ ID NO: 552 |
| 552 | 0 | VALYL-TRNA SYNTHETASE | *Haemophilus parainfluenzae* | P36432 | compliment of nt. 5850-6647 of SEQ ID NO: 552 |
| 553 | 0 | DNA-directed RNA polymerase, beta subunit | *Vibrio cholerae* | NP_229982.1 | nt. 2668-6699 of SEQ ID NO: 553 |
| 554 | 0 | iron utilization protein B | *Haemophilus influenzae* | T10887 | nt. 991-2508 of SEQ ID NO: 554 |
| 559 | 1.00E−100 | PREPROTEIN TRANSLOCASE SECA SUBUNIT | *Bacillus firmus* | P96313 | nt. 3420-4472 of SEQ ID NO: 559 |
| 56 | 2.00E−23 | RpL30 | *Pasteurella multocida* | NP_246336.1 | compliment of nt. 656-832 of SEQ ID NO: 56 |
| 56 | 9.00E−13 | RpS5 | *Pasteurella multocida* | NP_246337.1 | compliment of nt. 843-1064 of SEQ ID NO: 56 |
| 560 | 1.00E−157 | Na+/H+ antiporter | *Vibrio cholerae* | NP_231535.1 | 2 compliment of nt. 279-2989 of SEQ ID NO: 560 |
| 562 | 1.00E−72 | putative biotin sulfoxide reductase 2 | *Yersinia pestis* | NP_404419.1 | nt. 7862-8878 of SEQ ID NO: 562 |
| 562 | 1.00E−125 | restriction modification system-R protein | *Neisseria meningitidis* | CAA09003.1 | nt. 2-985 of SEQ ID NO: 562 |
| 563 | 0 | IMMUNOGLOBULIN A1 PROTEASE | *Haemophilus influenzae* HK715 | P45384 | compliment of nt. 4127-9508 of SEQ ID NO: 563 |
| 563 | 0 | 3-ISOPROPYLMALATE DEHYDRATASE (IPMI) | *Schizosaccharomyces pombe* | O14289 | nt. 1980-3983 of SEQ ID NO: 563 |
| 564 | 2.00E−79 | orf32 | *Haemophilus phage* HP2 | NP_536839.1 | nt. 6241-6831 of SEQ ID NO: 564 |
| 564 | 7.00E−33 | probable variable tail fibre protein | *Salmonella enterica* subsp. *enterica* serovar *Typhi* | NP_457882.1 | nt. 3707-4177 of SEQ ID NO: 564 |
| 564 | 2.00E−14 | M protein | Enterobacteria phage 186 | NP_052264.1 | nt. 1905-2213 of SEQ ID NO: 564 |
| 564 | 4.00E−44 | similar to tail fiber protein (gpH) in phage P2 | *Salmonella typhimurium* LT2, Fels-2 prophage | NP_461635.1 | nt. 3171-3692 of SEQ ID NO: 564 |
| 564 | 2.00E−85 | gpJ | Enterobacteria phage P2 | NP_046773.1 | nt. 2267-3166 of SEQ ID NO: 564 |
| 564 | 1.00E−24 | hypothetical protein | *Neisseria meningitidis* Z2491 | NP_284534.1 | nt. 6852-7334 of SEQ ID NO: 564 |
| 564 | 4.00E−26 | gpV | Enterobacteria phage P2 | NP_046771.1 | nt. 1337-1912 of SEQ ID NO: 564 |
| 564 | 2.00E−47 | similar to [SwissProt P44255 | *Escherichia coli* | BAA16182.1 | nt. 11383-11961 of SEQ ID NO: 564 |
| 564 | 2.00E−51 | hypothetical protein NMA1315 | *Neisseria meningitidis* Z2491 | NP_284066.1 | nt. 10452-11180 of SEQ ID NO: 564 |
| 564 | 0 | orf31 | *Haemophilus phage* HP1 | NP_043502.1 | nt. 4160-6226 of SEQ ID NO: 564 |

TABLE 3A-continued

| Contig | E score | Hit Identity | Organism | Genbank Protein | SEQ ID NO: |
|---|---|---|---|---|---|
| 564 | 2.00E−09 | rep | Haemophilus phage HP2 | NP_536816.1 | compliment of nt. 9986-10234 of SEQ ID NO: 564 |
| 565 | 2.00E−57 | resolvase/integrase-like protein | Haemophilus influenzae biotype aegyptius | AAL47097.1 | compliment of nt. 11885-12445 of SEQ ID NO: 565 |
| 565 | 1.00E−93 | integrase | Actinobacillus actinomycetemcomitans | AAC70901.1 | compliment of nt. 4118-4900 of SEQ ID NO: 565 |
| 565 | 6.00E−35 | probable phage integrase | Salmonella enterica subsp. enterica serovar Typhi | NP_458745.1 | compliment of nt. 4148-4990 of SEQ ID NO: 565 |
| 565 | 1.00E−107 | hypothetical protein | Xylella fastidiosa 9a5c | NP_299042.1 | compliment of nt. 5066-6817 of SEQ ID NO: 565 |
| 566 | 1.00E−126 | hypothetical protein (galE 5' region)- | Haemophilus influenzae | S15287 | compliment of nt. 10726-11607 of SEQ ID NO: 566 |
| 567 | 0 | unknown | Pasteurella multocida | NP_246387.1 | nt.5343-7688 of SEQ ID NO: 567 |
| 568 | 1.00E−151 | multidrug resistance membrane translocase | Escherichia coli O157:H7 | NP_311575.1 | nt. 6-1403 of SEQ ID NO: 568 |
| 568 | 1.00E−141 | YhbX/YhjW/YijP/YjdB family protein | Neisseria meningitidis MC58 | lNP_275002.1 | compliment of nt. 11213-12634 of SEQ ID NO: 568 |
| 570 | 1.00E−180 | hypothetical protein 3 (ksgA-lic2B intergenic region) | Haemophilus influenzae (strain RM7004) | S71024 | compliment of nt. 12845-13720 of SEQ ID NO: 570 |
| 571 | 0 | glycerophosphodiester phosphodiesterase | Haemophilus influenzae (isolate 772) | A43576 | nt. 1656-2693 of SEQ ID NO: 571 |
| 571 | 1.00E−137 | outer membrane protein P4 precursor- Haemophilus influenzae | Haemophilus influenzae | A43604 | nt. 6145-6909 of SEQ ID NO: 571 |
| 571 | 2.00E−72 | CG8298 gene product [alt 1] | Drosophila melanogaster | AAF58597.1 | nt. 3813-5339 of SEQ ID NO: 571 |
| 572 | 1.00E−40 | hypothetical protein TC0130 | Chlamydia muridarum (strain Nigg) | G81737 | nt. 3734-4099 of SEQ ID NO: 572 |
| 572 | 5.00E−10 | hypothetical protein | Pyrococcus horikoshii | NP_142215.1 | nt. 4472-4888 of SEQ ID NO: 572 |
| 572 | 3.00E−11 | 109aa long hypothetical protein | Sulfolobus tokodaii | NP_377117.1 | nt. 7303-7470 of SEQ ID NO: 572 |
| 572 | 8.00E−43 | hypothetical protein | Chlamydophila pneumoniae AR39 | NP_445524.1 | nt. 4289-4618 of SEQ ID NO: 572 |
| 572 | 9.00E−08 | CDH1-D | Gallus gallus | AAL31950.1 | nt. 7183-7521 of SEQ ID NO: 572 |
| 575 | 1.00E−173 | topoisomerase B | Salmonella enterica subsp. enterica serovar Typhi | NP_458624.1 | nt. 18980-20923 of SEQ ID NO: 575 |
| 575 | 1.00E−100 | DNA helicase | Salmonella enterica subsp. enterica serovar Typhi | NP_458617.1 | nt. 10399-11706 of SEQ ID NO: 575 |
| 65 | 2.00E−53 | Sufl | Pasteurella multocida | NP_245041.1 | nt. 3-821 of SEQ ID NO: 65 |
| 67 | 4.00E−39 | putative MFS family tranport protein (1st mdule) | Salmonella typhimurium LT2 | NP_462786.1 | compliment of nt. 125-1033 of SEQ ID NO: 67 |
| 7 | 4.00E−29 | putative membrane protein | Salmonella enterica subsp. enterica serovar Typhi | NP_458664.1 | compliment of nt. 2-559 of SEQ ID NO: 7 |

TABLE 3A-continued

| Contig | E score | Hit Identity | Organism | Genbank Protein | SEQ ID NO: |
|---|---|---|---|---|---|
| 72 | 2.00E−51 | serine transporter | *Vibrio cholerae* | NP_230946.1 | nt. 18-803 of SEQ ID NO: 72 |
| 74 | 3.00E−90 | hypothetical 21.8K protein (in locus involved in transformation)- | *Haemophilus influenzae* | JH0436 | compliment of nt. 248-766 of SEQ ID NO: 74 |
| 77 | 2.00E−18 | RecX protein | *Legionella pneumophila* | CAC33485.1 | nt. 480-920 of SEQ ID NO: 77 |
| 82 | 4.00E−95 | unknown | *Pasteurella multocida* | NP_246414.1 | nt. 128-955 of SEQ ID NO: 82 |
| 83 | 2.00E−66 | unknown | *Pasteurella multocida* | NP_246777.1 | nt. 5-556 of SEQ ID NO: 83 |
| 83 | 6.00E−33 | CTP SYNTHASE | *Helicobacter pylori* J99 | NP_223042.1 | compliment of nt. 1027-1338 of SEQ ID NO: 83. |
| 83 | 4.00E−34 | CTP synthase | *Campylobacter jejuni* | NP_281249.1 | compliment of nt. 1024-1275 of SEQ ID NO: 83 |
| 84 | 1.00E−16 | REPRESSOR PROTEIN CI | Bacteriophage phi-80 | P14819 | nt. 823-1233 of SEQ ID NO: 84 |
| 84 | 2.00E−05 | orf, hypothetical protein | *Escherichia coli* K12 | NP_415875.1 | compliment of nt. 533-700 of SEQ ID NO: 84 |
| 84 | 4.00E−11 | orf33 | bacteriophage phi CTX | NP_490633.1 | compliment of nt. 32-466 of SEQ ID NO: 84 |
| 85 | 3.00E−42 | SpoT | *Pasteurella multocida* | NP_245857.1 | nt. 899-1261 of SEQ ID NO: 85 |
| 90 | 1.00E−103 | putative methylase | Bacteriophage Tuc2009 | NP_108695.1 | compliment of nt. 478-1206 of SEQ ID NO: 90 |
| 90 | 4.00E−11 | probable adenine specific DNA methyltransferase | *Thermoplasma acidophilum* | NP_394624.1 | compliment of nt. 397-1140 of SEQ ID NO: 90 |

TABLE 3B

| Hit Identity | Full Length Nucleotide Sequence | Amino Acid Sequence | Location in Contig | Homology to Genbank Protein |
|---|---|---|---|---|
| CpdB | SEQ ID NO: 686 | SEQ ID NO: 687 | nt. 38041-36068 of SEQ ID NO: 681 (contig 14) | NP_246953.1 |
| putative membrane protein | SEQ ID NO: 688 | SEQ ID NO: 689 | nt. 906601-908094 of SEQ ID NO: 685 (contig 18) | NP_458664.1 |
| GTP-binding protein TypA/BipA | SEQ ID NO: 690 | SEQ ID NO: 691 | nt. 42557-40995 of SEQ ID NO: 683 (contig 16) | NP_240245.1 |
| outer membrane protein A | SEQ ID NO: 692 | SEQ ID NO: 693 | nt. 7000420-704187 of SEQ ID NO: 685 (contig 18) | T30852 |
| vacB protein | SEQ ID NO: 694 | SEQ ID NO: 695 | nt. 39184-36836 of SEQ ID NO: 683 (contig 16) | NP_240369.1 |
| putative ABC transport system permease protein [ | SEQ ID NO: 696 | SEQ ID NO: 697 | nt. 59155-58370 of SEQ ID NO: 685 (contig 18) | NP_282774.1 |
| putative exported protein | SEQ ID NO: 698 | SEQ ID NO: 699 | nt. 901142-902542 of SEQ ID NO: 685 (contig 18) | NP_458655.1 |
| ImpA | SEQ ID NO: 700 | SEQ ID NO: 701 | nt. 348187-347747 of SEQ ID NO: 685 (contig 18) | NP_245829.1 |
| TsaA | SEQ ID NO: 702 | SEQ ID NO: 703 | nt. 74941-75548 of SEQ ID NO: 684 (contig 17) | NP_245732.1 |
| PROBABLE TRANSPORT TRANSMEMBRANE | SEQ ID NO: 704 | SEQ ID NO: 705 | nt. 74436-75176 of SEQ ID NO: 685 (contig 18) | NP_522358.1 |

TABLE 3B-continued

| Hit Identity | Full Length Nucleotide Sequence | Amino Acid Sequence | Location in Contig | Homology to Genbank Protein |
|---|---|---|---|---|
| PROTEIN | SEQ ID NO: 706 | SEQ ID NO. 707 | nt. 75160-75660 of SEQ ID NO: 685 (contig 18) | |
| possible exported protein | SEQ ID NO: 708 | SEQ ID NO: 709 | nt. 899618-900262 of SEQ ID NO: 685 (contig 18) | NP_458653.1 |
| LICA PROTEIN | SEQ ID NO: 710 | SEQ ID NO: 711 | nt. 356917-355958 of SEQ ID NO: 685 (contig 18) | P14181 |
| HEME-BINDING PROTEIN A | SEQ ID NO: 712 | SEQ ID NO: 713 | NT. 26114-27739 of SEQ ID NO: 683 (contig 16) | P33950 |
| similar to BASEMENT MEMBRANE-SPECIFIC HEPARAN SULFATE PROTEOGLYCAN CORE PROTEIN PRECURSOR (HSPG) | SEQ ID NO: 714 | SEQ ID NO: 715 | nt. 311610-312683 of SEQ ID NO: 685 (contig 18) | XP_068727.1 |
| CzcD | SEQ ID NO: 716 | SEQ ID NO: 717 | nt. 34865-35542 of SEQ ID NO: 681 (contig 14) | NP_246276.1 |
| conserved hypothetical protein | SEQ ID NO: 718 | SEQ ID NO: 719 | nt. 194993-193977 of SEQ ID NO: 685 (contig 18) | NP_274972.1 |
| secretion protein SecD | SEQ ID NO: 720 | SEQ ID NO: 721 | nt. 203707-201857 of SEQ ID NO: 683 (contig 17) | NP_252510.1 |
| ABC transporter protein 1 | SEQ ID NO: 722 | SEQ ID NO: 723 | nt. 3943-5859 of SEQ ID NO: 681 (contig 14) | AAF31030.1 |
| conserved hypothetical protein | SEQ ID NO: 724 | SEQ ID NO: 725 | nt. 331090-331749 of SEQ ID NO: 685 (contig 18) | NP_273467.1 |
| | SEQ ID NO: 726 | SEQ ID NO: 727 | nt. 331938-332492 of SEQ ID NO: 685 (contig 18) | |
| | SEQ ID NO: 728 | SEQ ID NO: 729 | nt. 332681-33232 of SEQ ID NO: 685 (contig 18) | |
| INVASIN PRECURSOR (OUTER MEMBRANE ADHESIN) | SEQ ID NO: 730 | SEQ ID NO: 731 | nt. 416757-417020 of SEQ ID NO: 685 (contig 18) | P31489 |
| HEME/HEMOPEXIN-BINDING PROTEIN | SEQ ID NO: 732 | SEQ ID NO: 733 | nt. 229430-232195 of SEQ ID NO: 384 (contig 17) | P45355 |
| OPACITY PROTEIN OPA66 PRECURSOR | SEQ ID NO: 734 | SEQ ID NO: 735 | nt. 375592-375879 of SEQ ID NO: 384 (contig 17) | Q05033 |
| Hemoglobin-haptoglobin binding protein A | SEQ ID NO: 736 | SEQ ID NO: 737 | nt. 45709-42566 of SEQ ID NO: 681 (contig 14) | Q48153 |
| transport protein TatC | SEQ ID NO: 738 | SEQ ID NO: 739 | nt. 134452-135222 of SEQ ID NO: 384 (contig 17) | NP_253757.1 |
| LIPOPROTEIN NLPD | SEQ ID NO: 740 | SEQ ID NO: 741 | nt. 18895-20112 of SEQ ID NO: 682 (contig 15) | P40827 |
| Hemoglobin and hemoglobin-haptoglobin binding protein C precursor | SEQ ID NO: 742 | SEQ ID NO: 743 | nt. 34181-31041 of SEQ ID NO: 682 (contig 15) | Q9X442 |
| HimA | SEQ ID NO: 744 | SEQ ID NO: 745 | nt. 382795-383085 of SEQ ID NO: 685 (contig 18) | NP_245565.1 |
| transferrin-binding protein 1 | SEQ ID NO: 746 | SEQ ID NO: 747 | nt. 178537-175799 of SEQ ID NO: 683 (contig 16) | S70906 |

TABLE 3B-continued

| Hit Identity | Full Length Nucleotide Sequence | Amino Acid Sequence | Location in Contig | Homology to Genbank Protein |
|---|---|---|---|---|
| SapC | SEQ ID NO: 748 | SEQ ID NO: 749 | nt. 197754-196867 of SEQ ID NO: 685 (contig 18) | NP_245850.1 |
| heat shock protein HtpX | SEQ ID NO: 750 | SEQ ID NO: 751 | nt. 40414-41265 of SEQ ID NO: 682 (contig 15) | NP_273864.1 |
| HEME/HEMOPEXIN-BINDING PROTEIN | SEQ ID NO: 752 | SEQ ID NO: 753 | nt. 229430-232195 of SEQ ID NO: 684 (contig 17) | P45354 |
| HEME/HEMOPEXIN UTILIZATION PROTEIN B | SEQ ID NO: 754 | SEQ ID NO: 755 | nt. 227721-229418 of SEQ ID NO: 684 (contig 17) | P45356 |
| HEME/HEMOPEXIN UTILIZATION PROTEIN C | SEQ ID NO: 756 | SEQ ID NO: 757 | nt. 225516-227645 of SEQ ID NO: 684 (contig 17) | P45357 NP_246561.1 |
| iron utilization protein B | SEQ ID NO: 758 | SEQ ID NO: 759 | nt. 32076-33611 of SEQ ID NO: 684 (contig 17) | T10887 |
| PREPROTEIN TRANSLOCASE SECA SUBUNIT | SEQ ID NO: 760 | SEQ ID NO: 761 | nt. 82314-84785 of SEQ ID NO: 683 (contig 16) | P96313 |
| IMMUNOGLOBULIN A1 PROTEASE | SEQ ID NO: 762 | SEQ ID NO: 763 | nt. 171647-166263 of SEQ ID NO: 683 (contig 16) | P45384 |
| multidrug resistance membrane translocase | SEQ ID NO: 764 | SEQ ID NO: 765 | nt. 74524-72992 of SEQ ID NO: 683 (contig 16) | NP_311575.1 |
| YhbX/YhjW/YijP/YjdB family protein | SEQ ID NO: 766 | SEQ ID NO: 767 | nt. 61734-63200 of SEQ ID NO: 683 (contig 16) | NP_275002.1 |
| putative membrane protein | SEQ ID NO: 768 | SEQ ID NO: 769 | nt. 906601-908094 of SEQ ID NO: 685 (contig 18) | NP_458664.1 |
| putative membrane protein | SEQ ID NO: 770 | SEQ ID NO: 771 | nt. 16185-17942 of SEQ ID NO: 683 (contig) | NP_404859.1 |

EXAMPLE 3

Construction of the NTHi Promoter Trap Library

To identify potential virulence determinants of NTHi, bacterial gene expression was monitored by differential fluorescence induction (DFI) during early disease progression in one specific anatomical niche of a chinchilla model of NTHi-induced otitis media (OM). Genomic DNA fragments from NTHi strain 86-028NP were cloned upstream of the promoterless gfpmut3 gene using a promoter trap library. Plasmid pGZRS39A, a derivative of pGZRS-1 isolated from *Actinobacillus pleuropneumoniae*, is an *A. pleuropneumoniae-Escherichia coli* shuttle vector. This plasmid contains the origin of replication from *A. pleuropneumoniae*, the lacZa gene from pUC19 and the kanamycin resistance gene from Tn903. (West et al., *Genes,* 160: 81-86, 1995).

The promoter trap vector was constructed by cloning the GTP mutant gfpmut3 gene, as a BamHI to EcoRI fragment into pGZRS-39A to form pRSM2167. This mutant GTP gene contains two amino acid changes, S65G and S72A, that enhance fluorescence emission when excited at 488 nm. This mutant also has high solubility and fast kinetics of chromophore formation (Cormack et al., *Gene,* 173: 33-38, 1996). This plasmid was transformed by electroporation into NTHi strain 86-028NP, generating the parent-plasmid strain 86-028NP/pRSM2169.

Random genomic DNA fragments (described in Example 1) were prepared for ligation into the promoter probe vector. Genomic DNA was isolated from strain 86-028NP using the Puregene DNA isolation kit (Gentra Systems, Minneapolis, Minn.) according to the manufacturer's protocol. Due to restriction barriers, it was necessary to isolate the plasmid DNA and use this for the library generation. The isolated DNA was partially digested with Sau3AI (NEB, Beverly, Mass.; 0.25 units/μg DNA) for 1 hour at 37° C., separated by gel electrophoresis and DNA fragments 0.5-1.5 kb in size were recovered using the Qiagen gel extraction kit. For vector preparation, pRSM2167 was isolated from an overnight culture using the Wizard Plus Maxiprep DNA purification system (Promega, Madison Wis.) according to the manufacturer's protocol.

Plasmid DNA was linearized by BamHI digestion and 5' phosphate groups removed by treatment with calf intestinal alkaline phosphatase (CIAP; GibcoBRL Life Technologies). Genomic DNA fragments were ligated with the linearized, phosphatase-treated vector and electroporated into competent NTHi strain 86-028NP prepared for electroporation according to a modified protocol (Mitchell et al., *Nucleic Acids Res.,* 19: 3625-3628, 1991). When plasmid DNA was electroporated back into NTHi strain 86-028NP, transformation efficiency was improved by one-thousand fold. Briefly, cells were grown to an $OD_{600}$=0.3 in sBHI (brain heart infusion) broth at 37° C., 220 rpm. Cells were chilled on ice for 30 minutes and subsequently washed with an equal volume of 0.5×SG (1×SG: 15% glycerol, 272 mM sucrose) at 4° C. Washes were repeated a total of three times. Subsequently, the cells were diluted in 1×SG to a 100× concentrated volume.

The cells were electroporated using the BioRad Gene Pulser II set at 200 ohms, 2.5 kV and 25 µF and then diluted in 1 ml prewarmed sBHI, incubated for 2 hours at 37° C., 5% $CO_2$ and plated on chocolate agar for overnight growth of transformants.

Transformants were selected and frozen in pools of 1000 clones in skim milk containing 20% glycerol (vol/vol). A 68,000 member gfp promoter probe library was generated. Using the probability calculation of Clarke and Carbon (Cell, 9: 91-99, 1976), to achieve a 99% probability of having a given DNA sequence represented in a library of 300 bp fragments of strain 86-028NP DNA ($1.8 \times 10^6$ bp/genome), a library of 27,629 clones was needed. Therefore the present library represents 2.5 fold coverage of the 86-028NP genome.

In order to assess the quality of the library, fifty clones were selected at random, grown overnight on chocolate agar and the plasmids were isolated and insert DNA sequenced. A majority (64%) of the selected clones had insert sizes ranging between 200 and 500 bp while 32% exceeded 500 bp. The majority of inserts showed homology to unique *H. influenzae* strain Rd open reading frames (ORFs), and 15 clones had sequence unique to strain 86-028NP DNA. Of those clones with homology to strain Rd, 60% were in the correct orientation, 36% of which contained sequence upstream an ORF. Although a majority of clones had an insert size less than 500 bp, no correlation was found between small insert size and increased GFP expression. In fact four clones exhibited slight to moderate fluorescence in vitro, 3 of which had insert sizes between 200-500 base pairs and one had an insert that was greater than 700 base pairs.

A fraction of the library (approximately 1000 clones) was grown on chocolate agar, harvested in PBS and analyzed by flow cytometry for GFP fluorescence. Compared to strain 86-028NP/pRSM2169 that contains the promoter trap vector without insert DNA, the pool of library clones displays an increased fluorescence intensity. Thus, the library contains clones with promoters at varying levels of activity.

EXAMPLE 4

Analysis of 86-028NP Derivatives Expressing GFP

In order to establish the FACS parameters necessary to identify and sort gfp-expressing bacteria, a panel of isolates demonstrating varying levels of gfp expression was utilized. Background fluorescence was assessed using strain 86-028NP/pRSM2169 (negative control), therefore any observed fluorescence would be due to the lacZ promoter driving gfp expression. However, this strain does not produce detectable levels of GFP and in fact, does not demonstrate increased fluorescence when compared to the parent strain 86-028NP. A high-level gfp-expressing isolate was generated by cloning a 500 bp fragment containing the strong promoter for outer membrane protein P2 expression into SalI-BamHI digested pRSM2167. This plasmid was transformed into 86-028NP by electroporation, generating the high-level gfp expressing strain 86-028NP/pRSM2211 (highly fluorescent control). This strain demonstrated an approximate 100 fold increase in GFP fluorescence compared to strain 86-028NP/pRSM2169. An intermediate fluorescent derivative clone, 86-028NP/pKMM4B5 (intermediate fluorescent control), was isolated by FACS analysis and used both in preliminary experiments and as a control for cell sorting. The DNA fragment containing a promoter driving gfp expression in vitro is unique to strain 86-028NP, having no known homology to DNA of other organisms. This clone exhibits an approximate 10 fold increase in fluorescence compared to strain 86-028NP/pRSM2169.

The control strains were resuspended from growth on chocolate agar and labeled with cross-reactive Phycoprobe R-PE anti-human IgG (H=L) antibody (10µg/ml in 100 µl PBS; Biomeda Corp) for 30 minutes at 40° C. Following three successive washes to remove unbound antibody, bacteria were resuspended in 300 µl Dulbecco's Phosphate Buffered Saline (DPBS) for FACS analysis. These control preparations were used to set the appropriate size and fluorescence gates using a Coulter Epics Elite flow cytometer (Coulter Corp.) equipped with an argon laser emitting at 488 nm. Bacteria were gated for size based on log forward angle and side scatter detection and for sorting by FITC/PE labeling of bacteria. Sorted cells were collected into cold sBHI and plated on chocolate agar. After overnight growth, cells were collected for a secondary round of infection or were individually selected and grown overnight, screened by individual clone for fluorescence when grown in vitro, and frozen in skim milk containing 20% (vol/vol) glycerol prior to plasmid isolation and sequencing of insert DNA. Sorting efficiency of control strains was confirmed using a Coulter EPICS flow cytometer (Coulter Corp.).

Many plasmids were segregated rapidly in vitro in the absence of antibiotic selection. Thus, in order to assess whether the promoter trap vector used here was prone to this event, a single colony of strain 86-028NP/pRSM2211 (highly fluorescent control) was isolated on chocolate agar and passaged 20 times in the absence of antibiotic selection. No significant decrease in fluorescence intensity was observed when compared to bacteria grown in the presence of antibiotic. In addition, the plasmid is maintained in the absence of antibiotic selection in vivo. Similar bacterial counts were observed when bacteria-containing middle ear fluids collected from a chinchilla were plated on chocolate agar with or without kanamycin. These data demonstrate that the promoter trap vector was stably maintained in the absence of antibiotic selection.

In addition to problems with plasmid stability, early studies on the use of GFP as a reporter to study host-pathogen interactions demonstrated that GFP could be continuously synthesized as a cytoplasmic protein with low toxicity, having minimal effects on the bacterial cell-surface dynamics (Chalfie et al., *Science*, 263: 802-805, 1994). The construction of a high level gfp-expressing derivative allowed the assessment of the GFP toxicity on NTHi. Growth curves of both the wild-type strain (86-028NP) and the high GFP producing strain 86-028NP/pRSM2211 were compared when grown under similar conditions. The growth rates were similar, indicating that GFP expression was not toxic to the cells.

The 86-028NP gfp-expressing derivatives were used to define the parameters for efficient cell sorting. Strain 86-028NP/pRSM2169 was mixed with the intermediate gfp-expressing derivative, strain 86-028NP/pKMM4B5, at a 100:1 ratio, simulating the in vivo environment that is expected to contain a small percentage of gfp-expressing clones relative to the total bacterial population. This mixture was subjected to FACS analysis, collecting the 1.8% most fluorescent population and the 52% least fluorescent population. Flow cytometric analysis of the sorted populations revealed an enrichment of strain 86-028NP/pKMM4B5 to 65% of the bacterial population, a phenomenon that was not observed when sorting on the negative population. Subsequent rounds of sorting would be expected to further enrich for this intermediate fluorescent population. The inability to decrease the amount of fluorescent bacteria in the negative

EXAMPLE 5

Direct Labeling of Bacteria from Middle Ear Fluids

A similar strategy (as described in Example 5) was applied to sort fluorescent clones from effusions obtained from the chinchilla middle ear during AOM. Our ability to use differential fluorescence induction (DFI) in vivo was dependent upon our ability to sort gfp-expressing bacteria from non-fluorescent bacteria, fluorescent and non-fluorescent cellular debris, and eukaryotic cells.

Healthy adult chinchillas (*Chinchilla lanigera*) with no evidence of middle ear infection by either otoscopy or tympanometry were used to screen the library for promoter activity in vivo. Two pools of the NTHi/pRSM2169 library (1000 clones each) were grown overnight on chocolate agar containing kanamycin. The library was combined and diluted in cold 10 mM sterile PBS to $3.3 \times 10^6$ CFU/ml and 300 μl ($1.0 \times 10^6$ CFU; 500 CFU/clone) was used to inoculate the left and the right chinchilla transbullar cavity (2000 clones/ear). OM development was monitored by video otoscopy and tympanometry at 24 and 48 hours. The bacteria multiplied in the middle ear cavity, reaching a concentration 500 times the inoculum dose by 48 hours as expected (Bakaletz et al., *Infect. Immunity* 7: 2746-62, 1999). This bacterial adaptation to the host environment results in an inflammatory response, indicated by erythema, vessel dilation and bulging of the tympanic membrane, infiltration of polymorphonuclear cells (PMN's), and accumulation of fluid in the middle ear cavity as observed by otoscopy and microscopic examination of recovered effusions. Twenty-four and 48 hours later, middle ear fluids were retrieved by epitympanic tap, and prepared for FACS.

It is important to note that this analysis was limited to those bacteria recoverable in the middle ear fluid. In some cases it was necessary to lavage the middle ear cavity to collect the bacteria for FACS analysis. Thus, this analysis includes genes up-regulated when NTHi are loosely adherent to mucosae. NTHi has been observed to form a biofilm in the middle ear cavity in a chinchilla model of OM (Erhlich et al., *JAMA*, 287: 1710-5, 2002). Since the protocols described herein select for clones recovered from the planktonic population, it is not expected to recover those clones in which genes are up-regulated when the bacteria are associated with mucosal biofilms. Homogenization of middle ear mucosae and subsequent bacterial cell isolation however, would enable us to recover these clones. It is also possible that some GFP-expressing clones were recovered in the effusion, yet were adherent to eukaryotic cells present in the effusion as exfoliated cells, or in aggregates. These bacteria are difficult to recover from the effusion without compromising the sorting efficiency. Therefore the middle ear fluids were treated with a mucolytic agent, then centrifuged to remove large aggregates and eukaryotic cells and prior to labeling.

Chinchilla middle ear fluids were diluted, if necessary, to 250 μl with sterile saline. An equal volume of N-acetyl-L-cysteine (0.5%; w/v) in DPBS (pH 7.4) was added for 5 minutes at room temperature as a mucolytic agent (Miyamoto and Bakaletz, *Microb. Pathog.*, 21: 343-356 1996). Fluids were centrifuged (300×g, 5 min) to remove cellular debris, red blood cells and inflammatory cells, and supernatants containing bacteria were transferred to a fresh tube. Bacteria were incubated with chinchilla antiserum (1:50 dilution) directed against a whole OMP preparation, derived from NTHi strain 86-028NP, for 45 minutes at 4° C., pelleted by centrifugation (2000×g, 5 min) and washed twice with cold DPBS containing 0.05% bovine serum albumin. Bacteria were subsequently labeled with cross-reactive phycoprobe R-PE anti-human IgG (H+L) antibody (10 μg/ml in 100 μl PBS; Biomeda Corp) for 30 minutes at 4° C. Following three successive washes to remove unbound antibody, cells were resuspended in 300 μl DPBS for FACS analysis.

EXAMPLE 6

Identification of Promoters Induced in Vivo in Acute Otitis Media

*H. influenzae* 86-028NP transformed with the promoter trap library was grown overnight on chocolate agar. To select against those clones containing promoters that expressed gfp in vitro, the library was subjected to one round of FACS analysis (as described in Example 6), collecting only those clones expressing low-level amounts of GFP. These clones were pooled and used to inoculate the chinchilla middle ear transbullarly. Following 24 and 48 hours of infection, bacteria-containing effusions were removed by epitympanic tap. Bacteria were indirectly labeled with R-PE-labeled antibody and subjected to FACS analysis by gating on fluorescently tagged bacteria but sorting for those that were also expressing. These clones were used to reinfect animals for further enrichment. Following the final round of sorting, single colony isolates were screened in vitro for lack of fluorescence.

Those clones isolated by FACS analysis (positive for GFP fluorescence in vivo), which did not emit fluorescence in vitro were prepared for plasmid isolation and identification of insert DNA sequence. These clones were grown overnight on chocolate agar plates containing kanamycin and prepared for plasmid isolation using the Qiaprep Miniprep Kit (Qiagen) according to the manufacturer's protocol. Plasmid insert DNA was sequenced using the primer 5'-TGCCCATTAA-CATCACCATCTA-3' (SEQ ID NO: 588) that is complementary to the gfpmut$^3$ gene and downstream of the insert DNA. Sequencing reactions were performed using the ABI prism BigDye® terminator cycle sequencing ready reaction kit (Applied Biosystems) according to manufacturer's protocol using a GeneAmp PCR System 9700 (Applied Biosystems). The sequences were then purified by passage through sephadex G-50 in a 96-well multiscreen HV plate (Millipore) and subsequently analyzed on an ABI Prism 3100 DNA analyzer (Applied Biosystems).

Insert sequences were compared to the complete annotated sequence of *H. influenzae* strain Rd. Those inserts with no nucleotide homology to strain Rd were subsequently analyzed using the BLASTN and BLASTX algorithms. Further sequence analysis was performed with DNASTAR (Madison, Wis.). Inserts in the correct orientation and containing sequence 5' to a predicted ORF contained a putative promoter that was preferentially active when the NTHi bacteria were in the chinchilla middle ear.

Fifty-two clones with putative promoters that were regulated in vivo were isolated. Of the 44 candidate clones containing sequence similar to that identified in *H. influenzae* strain Rd, quantitative comparison of gene expression in vitro and in vivo confirmed up-regulated gene expression for twenty-six genes (60%) when NTHi respond to environmental cues present in the chinchilla middle ear and these genes are summarized in Table 4A below. The in vivo-regulated promoters driving expression of genes are predicted to be involved in membrane transport, environmental informational processing, cellular metabolism, gene regulation, as well as hypothetical proteins with unknown function.

In order to confirm the induction of putative promoter candidates in vivo, the relative amount of messenger RNA expression was compared when NTHi strain 86-028NP was grown in vitro to mid-log phase or in vivo for 48 hours. The RNA was isolated using TRIzol LS reagent (Gibco Life Technologies) according to the manufacturer's protocol. DNA was removed from the RNA preparation using DNA-free kit (Ambion) according to the manufacturer's protocol. DNase I treated RNA samples were purified by passage through a Qiagen RNeasy column. RNA purity and integrity was assessed by 260/280 nm spectrophotometer readings and on the Agilent 2100 Bioanalyzer (Agilent Technologies), respectively.

In order to independently confirm the FACS data, we determined the relative expression of candidate genes by quantitative RT-PCR. The parent strain 86-028NP, was used for these studies. Real-time quantitative RT-PCR using the one-step QuantiTect SYBR Green RT-PCR kit (Qiagen) assessed transcription levels according to the manufacture's instructions. Briefly, using primers generated to an open reading frame downstream of the putative in vivo-induced promoters identified by FACS analysis, gene-specific mRNA was reverse transcribed and amplified by RT-PCR on the ABI Prism 7700 sequence detection system (Applied Biosystems). The amount of product was calculated using a standard curve generated to known amounts of bacterial genomic DNA ($10^2$-$10^7$ genomic copies DNA) by amplifying a fragment of the gyrase (gyr) gene. Controls were analyzed in parallel to verify the absence of DNA in the RNA preparation (−RT control) as well as the absence of primer dimers in control samples lacking template RNA. In addition, RT-PCR products were analyzed by gel electrophoresis and, in all cases, a single product was observed at the appropriate base pair size. Amounts of bacterial RNA between samples were normalized relative to gyr expression, shown to be constitutively expressed under various growth conditions that we tested in vitro. Known amounts of bacterial genomic DNA ($10^2$-$10^7$ genomic copies DNA) were used to generate a standard curve for RT-PCR quantitation by amplifying a fragment of the gyrase (gyr) gene. Gyrase is constitutively expressed in vitro under various growth conditions and was therefore used to normalize total bacterial RNA levels between samples. Relative gene expression in vivo was compared to that of gene expression in vitro and data expressed as fold-increase are summarized in Table 4A.

The 8-fold sequencing of the NTHi genome identified the full length open reading frames for the majority of genes listed in Table 4A. Table 4B provides the full length nucleotide sequence within the NTHi genome and the corresponding amino acid sequence. The fold induction of the gene due to environmental cues present in the chinchilla middle ear and the product or function of the gene are repeated in Table 4B for convenience.

TABLE 4A

| Category | Gene or ORF | SEQ ID NO: | GenBank Protein ID | Fold Induction | Product or Function |
|---|---|---|---|---|---|
| Amino acid metabolism | hisB | 589 | NP_438632 | 2.9 | Histidine biosynthesis bifunctional protein |
| Lipoprotein | lppB | 590 | NP_438862.1 | 2.6 | Lipoprotein B homologue |
| Membrane transport | sapA | 591 | NP_439780.1 | 2.8 | Peptide ABC transporter; periplasmic SapA precursor |
| | lolA | 592 | NP_439736.1 | 2.4 | Outer membrane lipoproteins carrier protein precursor |
| | rbsC | 593 | NP_438661.1 | 5.1 | Ribose transport system permease protein |
| Purine synthesis | purE | 594 | NP_439757.1 | 51.7 | Phosphoribosylaminoimidazole carboxylase catalytic subunit; PurE |
| Biosynthetic and metabolic functions | ribB | 595 | NP_438923.1 | 8.3 | 3,4-dihydroxy-2-butanone 4-phosphate synthase; riboflavin biosynthesis |
| | arcB | 596 | NP_438753.1 | 10 | Ornithine carbamolytransferase; arginine degradation |
| | uxuA | 597 | NP_438228.1 | 3.1 | Mannonate dehydratase; production of glyceraldehyde 3-phosphate |
| | dsbB | 598 | NP_438589.1 | 2.6 | Disulfide oxidoreductase; disulfide bond formation protein B |
| | ureH | 599 | NP_438693.1 | 3.9 | Urease accessory protein |
| | licC | 600 | NP_439688.1 | 2.3 | Phosphocholine (ChoP) cytidylyltransferase |
| | HI1647 | 601 | NP_439789.1 | 2.0 | Putative pyridoxin biosynthesis protein; singlet oxygen resistance protein |
| DNA replication, repair | ispZ | 602 | P43810 | 2.5 | Probable intracellular septation protein |
| | radC | 603 | NP_439113.1 | 2.1 | DNA repair protein |
| | mukF | 604 | P45185 | 2.0 | MukF protein homologue; remodeling of nucleiod structure |
| Gene regulation | glpR | 605 | NP_438777.1, NP_439170.1 | 2.8 | Glycerol-3-phosphate regulon repressor |

TABLE 4A-continued

| Category | Gene or ORF | SEQ ID NO: | GenBank Protein ID | Fold Induction | Product or Function |
|---|---|---|---|---|---|
| | ihfB | 606 | P43724 | 2.5 | Integration host factor beta subunit |
| | argR | 607 | NP_439365.1 | 2.7 | Arginine repressor |
| | cspD | 608 | NP_439584.1 | 2.1 | Cold shock like protein; stress response protein |
| Hypothetical or unknown proteins | HI0094 | 609 | NP_438267.1 | 8.3 | Hypothetical protein |
| | HI1163 | 610 | NP_439321.1 | 2.3 | Conserved hypothetical protein; putative oxidase |
| | HI1063 | 611 | NP_439221.1 | 2.7 | Hypothetical protein |
| | HI0665 | 612 | NP_438824.1 | 2.8 | Hypothetical protein |
| | HI1292 | 613 | NP_439444.1 | 2.6 | Hypothetical protein |
| | HI1064 | 614 | NP_439222.1 | 2.6 | Hypothetical protein |

TABLE 4B

| Category | Gene or ORF | Full Length Nucleotide Sequence | Amino Acid Sequence | Location in Contig | Fold Induction | Product or Function |
|---|---|---|---|---|---|---|
| Amino acid metabolism | hisB | SEQ ID NO: 615 | SEQ ID NO: 616 | nt. 68378-67290 of SEQ ID NO: 680 (contig 13) | 2.9 | Histidine biosynthesis bifunctional protein |
| Membrane transport | sapA | SEQ ID NO: 617 | SEQ ID NO: 618 | nt. 200403-198709 of SEQ ID NO: 685 (contig 18) | 2.8 | Peptide ABC transporter; periplasmic SapA precursor |
| | rbsC | SEQ ID NO: 619 | SEQ ID NO: 620 | nt. 42773-41802 of SEQ ID NO: 680 (contig 13) | 5.1 | Ribose transport system permease protein |
| Purine synthesis | purE | SEQ ID NO: 621 | SEQ ID NO: 622 | nt. 219625-219131 of SEQ ID NO: 685 (contig 18) | 51.7 | Phosphoribosylaminoimidazole carboxylase catalytic subunit; PurE |
| Biosynthetic and metabolic functions | ribB | SEQ ID NO: 623 | SEQ ID NO: 624 | nt. 131537-132184 of SEQ ID NO: 682 (contig 15) | 8.3 | 3,4-dihydroxy-2-butanone 4-phosphate synthase; riboflavin biosynthesis |
| | arcB | SEQ ID NO. 625 | SEQ ID NO: 626 | nt. 49710-48706 of SEQ ID NO: 681 (contig 14) | 10 | Ornithine carbamolytransferase; arginine degradation |
| | uxuA | SEQ ID NO: 627 | SEQ ID NO: 628 | nt. 840671-841855 of SEQ ID NO: 685 (contig 18) | 3.1 | Mannonate dehydratase; production of glyceraldehyde 3-phosphate |
| | dsbB | SEQ ID NO: 629 | SEQ ID NO: 630 | nt. 388050-388583 of SEQ ID NO: 384 (contig 17) | 2.6 | Disulfide oxidoreductase; disulfide bond formation protein B |
| | ureH | SEQ ID NO: 631 | SEQ ID NO: 632 | nt. 4452-5267 of SEQ ID NO: 680 (contig 13) | 3.9 | Urease accessory protein |
| | licC | SEQ ID NO: 633 | SEQ ID NO: 634 | nt. 355083-354382 of SEQ ID NO: 385 (contig 18) | 2.3 | Phosphocholine (ChoP) cytidylyltransferase |
| | HI1647 | SEQ ID NO: 635 | SEQ ID NO: 636 | nt. 664017-664892 of SEQ ID NO: 685 (contig 18) | 2.0 | Putative pyridoxin biosynthesis protein; singlet oxygen resistance protein |
| DNA replication, repair | ispZ | SEQ ID NO: 637 | SEQ ID NO: 638 | nt. 4512-5069 of SEQ ID NO: 683 (contig 16) | 2.5 | Probable intracellular septation protein |
| | radC | SEQ ID NO: 639 | SEQ ID NO: 640 | nt. 132695-132030 of SEQ ID NO: 683 (contig 16) | 2.1 | DNA repair protein |
| | mukF | SEQ ID NO: 641 | SEQ ID NO: 642 | nt. 504549-503215 of SEQ | 2.0 | MukF protein homologue; |

TABLE 4B-continued

| Category | Gene or ORF | Full Length Nucleotide Sequence | Amino Acid Sequence | Location in Contig | Fold Induction | Product or Function |
|---|---|---|---|---|---|---|
| Gene regulation | | | | ID NO: 685 (contig 18) | | remodeling of nucleiod structure |
| | glpR | SEQ ID NO: 643 | SEQ ID NO: 644 | nt. 72716-73483 of SEQ ID NO: 682 (contig 15) | 2.8 | Glycerol-3-phosphate regulon repressor |
| | ihfB | SEQ ID NO: 645 | SEQ ID NO: 646 | nt. 661004-660720 of SEQ ID NO: 685 (contig 18) | 2.5 | Integration host factor beta subunit |
| | argR | SEQ ID NO: 647 | SEQ ID NO: 648 | nt. 178540-178085 of SEQ ID NO: 685 (contig 18) | 2.7 | Arginine repressor |
| | cspD | SEQ ID NO: 649 | SEQ ID NO: 650 | nt. 435310-435528 of SEQ ID NO: 685 (contig 18) | 2.1 | Cold shock like protein; stress response protein |
| Hypothetical or unknown proteins | HI1163 | SEQ ID NO: 651 | SEQ ID NO: 652 | nt. 137202-134119 of SEQ ID NO: 685 (contig 18) | 2.3 | Conserved hypothetical protein; putative oxidase |
| | HI1063 | SEQ ID NO: 653 | SEQ ID NO: 654 | nt. 35158-34937 of SEQ ID NO: 685 (contig 18) | 2.7 | Hypothetical protein |
| | HI0665 | SEQ ID NO: 655 | SEQ ID NO: 656 | nt. 17949-18980 of SEQ ID NO: 679 (contig 12) | 2.8 | Hypothetical protein |
| | HI1292 | SEQ ID NO: 657 | SEQ ID NO: 658 | nt. 555002-555799 of SEQ ID NO: 685 (contig 18) | 2.6 | Hypothetical protein |

EXAMPLE 7

Identification of Virulence-Associated Genes

In many bacterial species, a subset of virulence-associated genes is regulated by errors in replication of short repeats. These repeats may be 5' to a gene or in the coding sequence, and their presence is an indication of controlled expression of the gene, which indicates association with virulence. Addition or deletion of a repeat results in the expression or of lack of expression of the particular virulence determinant.

The NTHi *H. influenzae* strain 86-028NP contig set was queried for short oligonucleotide repeats. The region surrounding the repeats was analyzed to identify the gene(s) associated with the repeat. Table 5 lists the identified repeats and the ORF (identified by BLAST) associated with each repeat.

Further sequence analysis has identified the full length nucleotide sequence of the virulence-associated genes and the corresponding amino acid sequences encoded by the ORF. The derived amino acid sequences are highly homologous to the listed Genbank sequence.

TABLE 5

| Repeat | Location in 3-fold Contigs | Location in 8-fold Contigs | Full Length Nucleotide Sequence | Amino Acid Sequence | Genebank Accession No. |
|---|---|---|---|---|---|
| SEQ ID NO: 581 | 115 nt. 473-540 of SEQ ID NO: 115 | nt. 484533-483643 of SEQ ID NO: 685 (contig 18) | SEQ ID NO: 659 | SEQ ID NO: 660 | NP_439538.1 |
| SEQ ID NO: 582 | 377 nt. 546-597 of SEQ ID NO: 337 | nt. 416274-414910 of SEQ ID NO: 685 (contig 18) | SEQ ID NO: 661 | SEQ ID NO: 662 | P45217 |
| SEQ ID NO: 583 | 505 nt. 310-393 of SEQ ID NO: 505 | nt. 414500-416614 of SEQ ID NO: 684 (contig 17) | SEQ ID NO: 663 | SEQ ID NO: 664 | AAK76425 |
| SEQ ID NO: 584 | 508 nt. 2079-2120 of SEQ ID NO: | nt. 506516-507913 of SEQ ID NO: | SEQ ID NO: 665 | SEQ ID NO: 666 | NP_439520 |

TABLE 5-continued

| Repeat | Location in 3-fold Contigs | Location in 8-fold Contigs | Full Length Nucleotide Sequence | Amino Acid Sequence | Genebank Accession No. |
|---|---|---|---|---|---|
|  | SEQ ID NO: 508 | 685 (contig 18) |  |  |  |
| SEQ ID NO: 585 | 518 nt. 758-789 of SEQ ID NO: 518 | nt. 354274-352406 of SEQ ID NO: 684 (contig 17) | SEQ ID NO: 667 | SEQ ID NO: 668 | NP_284893 |
| SEQ ID NO: 586 | 543 nt. 1814-196 of SEQ ID NO: 543 | nt. 347864-243236 of SEQ ID NO: 685 (contig 18) | SEQ ID NO: 669 | SEQ ID NO: 670 | AAA20524 |
| SEQ ID NO: 586 | 543 nt. 1814-196 of SEQ ID NO: 543 | nt. 699709-704187 of SEQ ID NO: 685 (contig 18) | SEQ ID NO: 671 | SEQ ID NO: 672 | AAD56660 |
| SEQ ID NO: 587 | 567 nt. 13309-13320 of SEQ ID NO: 567 | nt. 85546-84689 of SEQ ID NO: 681 (contig 14) | SEQ ID NO: 673 | SEQ ID NO: 674 | ZP_00053190 |

EXAMPLE 8

Identification of Unique NTHi Gene Sequences

Genes associated with NTHi virulence were also identified by comparing the level of expression of the gene when the NTHi bacterium was infecting a tissue verses the level of expression of the same gene when the NTHi was grown on artificial laboratory media. These novel genes were identified using the promoter trap techniques described above in Examples 4-6, and subsequently comparisons with the known Rd genome demonstrated these genes are unique to NTHi strain 86-028NP.

The DNA sequence identified using this screening procedure are set forth as SEQ ID NOS: 577-580. These sequences did not contain genes or gene fragments that have homologues in the *H. influenzae* Rd. genome sequence. Even though these are completely novel sequences, due to their expression level during NTHi infection in the chinchilla middle ear, it is likely that expression of these genes are involved in NTHi virulence.

SEQUENCE LISTING (771 sequences)

SEQ ID NO: 1 - DNA, 1008 bp, H. influenzae
  misc_feature (11)..(11): n = a, c, g, or t
  misc_feature (16)..(16): n = a, c, g, or t
  misc_feature (21)..(21): n = a, c, g, or t
  misc_feature (37)..(37): n = a, c, g, or t
  misc_feature (588)..(588): n = a, c, g, or t
  misc_feature (685)..(685): n = a, c, g, or t
  misc_feature (741)..(741): n = a, c, g, or t
  misc_feature (753)..(753): n = a, c, g, or t
  misc_feature (784)..(784): n = a, c, g, or t
  misc_feature (812)..(812): n = a, c, g, or t
  misc_feature (893)..(893): n = a, c, g, or t
  misc_feature (895)..(895): n = a, c, g, or t
  misc_feature (1008)..(1008): n = a, c, g, or t
ctgttatacgnaattncgggncctcggtacccctttncaaatcagcccttatgcgttttatgatgcaggtcagttccgttataatagcgaaaatgctaaaattacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagttttataactatatgctttacccgccaatttacagtctatacgcaacccttttttacccctgtatatcaagcaaaccaagcaatgctaaaaaacaatttatatgataaactaaaatatactccgcaccatggcgatacaagggatttaataatatgacaaaagaaaatttgcaaaacactccacaaaatacgaccgtttcacttgtggaatcaaacaacaaccaaacttccccgcaaatgcttcaacaatcacccanacctagcctattgcgcttggacaacatatcgaaaaaaagatatgagtttgcttgtcgtgaataatggggattctggaaaaatggatgctaatttggnaggcgttcacgatattgaatttgacgcacccgctcagctagcatatctaccccganaattactcattnattttgccactcgtctcgctaatgcaattancacacttcttttccgacccccgaatggncaaattctggaagaaggggcggttaaagatgaatagcctgcaccgctggttgcacctgatttttgcctcttccccctacgntnacgcagaccatattctcataaatataatatcaaccagattcccgagggggtctttcatttagcacagaaacctctctatgcaaaattcggattttttacttacgaatcaagcn

SEQ ID NO: 2 - DNA, 901 bp, H. influenzae
  misc_feature (1)..(2): n = a, c, g, or t
  misc_feature (10)..(10): n = a, c, g, or t
  misc_feature (28)..(28): n = a, c, g, or t
nntttcatgncactatcccactatgtgncctgcagaacaatcttataggaccccttcatagtttttatgggaattaaaatgaccgattttagattaaacaaacatccctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaagatagtgatacaaaaacaccaccaaaaattgctgaaacggtaaaaacggccaaaacgccccccccagaacaagcaaacaatattaaagacatcgccaaataccatacgggtgttattgtccctgaagctgggctttttcgtccaaccgctcccccattcgtgttgtccataacacccccccatttattactaccgcccgcttacgttcacatctttccttttcttcgccgcgctttcatcatttttctccggcatttttacataagtagtcccttcccgcttccctcctctcctcttcctccttatttttattatgatgtttataagaatctcctctcttacctattccagcctcgttgttctactcgccttctgctaaccctttctcccttttccatcctctctaccccgccccccctttctcttttttttccccctttcttttttccccccacccctcacttttccccgctttattttttacacaccccccgacacaacattcatctccctttgtatccgctcatctttccccccccccccccaccatcctccgcactctatctttccattctatacccccccttcccttttcccccccccccccctttccgactgcaattttttttcttctccccctccg

SEQ ID NO: 3 - DNA, 1250 bp, H. influenzae
  misc_feature (1000)..(1000): n = a, c, g, or t
agtcacggtcataatcattaaggcgaccacgcctgtaattgccattgcttctatgcaactattaaataaggtttttaaggttaattctttatacacaaatttaccaataattatagagtatgctgctgcaacaatggcagattctgttggactgaataagcctgaaaaaataccgccgataattaataatggcgttaagattgcccaaaaagattgtttaaagctgctgcaaagttgttctcttgtggcttttggtgtacgtggataacctcgtttttttgcaatgcgataattcattgccattaaagctaaagtaattaatacaccgggaataaaacctgcaataaagagttttgcgatagattcattggcgatgacaccgtaaataatcattgcaatacttggtggaactaatggcccaataatacaagaagcagcagtaattcctccgcaaatatcatcgtcataaccagcatcacgcattgctttaatctcaagctgacctaaaccgcctgcatcagctaatgcggatcctgacatacctgaaaataataaacttgcgccgatattaacgtgtcccattcctcctgtgtaatgaccgagtaaggatttagcgaaattaaaaatacgttcggtaatcccaccagtattcattagaatacccgttaaaatataaaacggcacggcaagtaatggaaagctgtctaggctatagactaatttttcagttgcggcatttacgacgttccaacgtgtcatagaaaaataaagtagggtagcaataaataaggaccaacctacagggacaccgataaacataatgatgagccaaacgagtaaggcaatatagactgaacttgaaccgagctttatataattgctaattcgcaatactttgaaccaatctggcgcgaaaaataaaattgcaaataaaatgaccgcacttatgataaagaaagtcgcaggtaaatagcttttccctgtcttaaagtttatgggnttgcgcttggataaagcgaaacatcattaatattgcgataacaggtagtgcagcgaaaatccatttttcagaaatgccccctaaagcatcaataggggaatgatgcgtcattaaaagtacgaatacccgaatgaataaaccagaaatactaccaagactaatattgtcccaaaggaatgggaaaattttgaatttttcgggctcaaatagttaaaaaacaaaaaacactggtcttggttttttaacgcac

SEQ ID NO: 4 - DNA, 905 bp, H. influenzae
gctaaaagtatagctcataaattggatctccctacgttatgtttaagtgatgtgttgtgttacggctcgactaccataatttcaagattggtatgtaatccacgtggtaatgtcgaaccttttctgcctcgttctgcgcggaacttttgcagatcttctggttttaatacaatttttcgttttccagaataaaattcaagacttgcttgatctgaaataagcaataattttgtcaatagttcgctacgatcttttgcattcgctgcgggaatagtgatcattttattgcctttaccttttgataataccggtaaatcttgtgctggaaaaatcaacattctgcctgctgatgtgattgcgacaacaagtgcggtagaatttatcaatgttttaggcttcaacactttggcattttctggtaaagaaatcaaggcttttccagccttgttacgtgcaattaaatcttcaaatttacaaataaaaccatatcctgcatcagaagccatcaataattcttgctgttcgctggccattacaacatattcaatggtcgcaccagtgggtaaattgagtttacctgtaagtggttcgccttgggagcgagcggaaggcaaggaaagcggatcgagtgcataactccgccccgtgctatcttcgatcccatggttgcttactttttccaccccccgatctccataccttttcccagctttgccccttattgcttcacgacccatttttttttttcttccccccgtttctcgtccccttctgtaatgttttttgttctggctttttgtgcgcgcctaccactctcttatcattttttgcctccccgccgccgtcccattgtcaacctccgtcgcgctcccctactcttttccctcttgtctccccccgccttg

SEQ ID NO: 5 - DNA, 1083 bp, H. influenzae
tgtaagaacgactgtcccaatgtaatgctaaaaagtattttaagattttagcattggagacactccctaagaacggaatttctgaaaatttggtgtaagtagaactattgttagagaagcaatggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaacgcaaaactgaaatagagattgctggttttatgctggtcagtaggggaaagggtaccagttcatgaagagattaaacctcagactgggaattattcaaaatggatgaatactataaacaaactttcgaatcttgtcaatgcggattgacctgtttgttcaatttatgcctggtttaaactgacttgactggacccgtt

SEQ ID NO: 6 - DNA, 862 bp, H. influenzae
gagaccccctcttaaattgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctggcgcaaacaggtaaaggcgtaccgtgaggtgtggtaaaaa

SEQ ID NO: 7 - DNA, 906 bp, H. influenzae
  misc_feature (902)..(902): n = a, c, g, or t
acagttgagtgagtcgagtaaccgcattccaaaatccagcatccacgctaccaccgtaaccttgatacattttcccttttgaaacatctatgttttcagagcgtaaaagtgttctcaataaagcttcatcttggttgtcgatagagttaaagaaatcactcacctgggcagataagttttgacgcatatctgtaagtaagcgagattttaatccagctccactttcatcccaccattgatcacaacttgggaaaccaccttttcccgaattaggtaatgccgcatctcgatttgcatcataagggaacgtgctaataggttgctgagccctaaaacgagggtagagctcgctgttattaataagcaatttaccacctaaccaggatgtttcgcggatttgtgccggactcaaggcaagttggcttgtttgtaatttttgacgagccgggatatagcattgttgcacaaattgctgcacttcagttaataatgctgggttagtgatttttttgatgttgcacttcaaatctaacctgacgtaaatcacgctggcaaggcaatacctgcagtcataccataagttagacctttatccactttgtgcatcaacatccaccaaatagggaattcgggctttgtctgtctccaaatggttgtcggaaatggcgcatagccctgatttatccgggaagcaggaacttatagcccattgaatagaatgaacgtcattgatttcaaggttattcatgataccgggattagaggggcctatgtcaaaacacgatagcatgtgggaaggaattcgattgtgagcagcggattaataatccctttctcacttcatatccccttgttaactcgtcacgcaattttaaagatcatccgataagcggaggagcatnaccc

SEQ ID NO: 8 - DNA, 1043 bp, H. influenzae
agttattccacgtataaaacagtataattccatcaatagatcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcttcttacccaacacagctaaccaattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcatcttacaattaatttatataagtaaaaatatcttgcttttatcatcgttaaacttagaataaatataaataattatcattaagattt

SEQ ID NO: 9 - DNA, 870 bp, H. influenzae
  misc_feature (733)..(733): n = a, c, g, or t
  misc_feature (801)..(801): n = a, c, g, or t
aaaagtatgccacgttttttcatatcctttttgctttcaacctttacccgcccgttattgtcataatcaacacgaggacgtgataattctgctttcaaatactcaagctctttgatattgctcgataggcttatcagttcatcgtcagggtaaacatccccatgctttactgctcgataggttttatagaatctatctcgcaacgcccaccaagattgggctttaatgttcgaaaacatatcttgattcttttttcctttgatatattcacgctcgggataagcaactgcaccaccagcattaaatccttccacttgtaaagattttggcaagcgtttaaagtgagcttttactcccgcccccacgccaatactatcgaatataatcaaatcagctttaaatttgaccgcactttgatttgttcggttggcggaatcaatcacatcgccattcttccaaacttcaatgtcaagcaccacagaaccgtgaacaaatgcattatcgttactatccgcaccctcatcagccacatcaaagccaactttcttcattcctttagcggtaaaaccgagcttgagatgcgcatccaccgcacattcaatccatacaggcttaataatggctaaatcggaatcagccacaggctcgccctcataaacgtgacgataaagttcataatcacgctcacgcatctgctccatatcttccattaattctttcggaaaatatgggnttgtcttgccaattcactaagaccgatttacaccgctcaggcggatgaatcacaaaacgctgataggnatcatcaagaatattcttcgggttaaagctcacaataatctgcgaaaccgtctcacgaatgggttggac

SEQ ID NO: 10 - DNA, 1188 bp, H. influenzae
  misc_feature (1032)..(1032): n = a, c, g, or t
  misc_feature (1150)..(1150): n = a, c, g, or t
  misc_feature (1157)..(1157): n = a, c, g, or t
  misc_feature (1171)..(1171): n = a, c, g, or t
ggcggttttttattatgctaataatctatttctttaagtaaaaaatctagagattgtatgaaaaagcttgttctgattacttaaagttatcaaacagctcaataaaaatatatttagatacaaaatgtttacgctaatttaagaaaaacgccccatctttttttaagataaatggggaaaaaatattaaagagttataaacccatcataaatatgggtcgcctcgcctgtcatataaagtggatgaccaacaccattccattcgatcatgagcgaaccgcccggtaaatctacttggacattgttgtttaataagccttgcataattccaactgcaacagctgcacaagcaccacttccacaggcttgagtttcgccagcaccacgttcataaactctaagcttaatatgttctttgttgatgatttgcataaaaccagcattgacacgctcaggaaaacgttcgtggctttctaacaaaggaccaagctgttcaacatttgctgtttgaatatcatctacttgtacaacacaatgaggattccccattgaaactgcaccacatagtacggtttgaatatctgtacgcagaatataatttttctcaaatttatttgcggtaaatggaatttttgctggttcccaaattggttcgcccatattcacacgaatttgattatcatcttttaccgtcaaaaccatattacccttttgtgtgctaaccgagatgtcttttttgttagttagcccttttaatgtcacaaaccgagcaaaacaacgagcaccatttccgcattgcgaaacttcgcttccatcagcattaaaaattctataatgaaagtcgagttcaggatcgtaaggagcttcaacaattaaaagttgatcaaacccaattccacaatggcgattggctaaacgtcggatcgtttctggagtaaaaaacacattttgagtgactccatcaaccacaacaaaatcgttacctaatccgtgcattttggaaaactgcatttttccatcctttgtataaatncaagatttttgcattataaagagcagcaaaatcatgggcaataaagcactctagtttaagcaaagtgcgggtaaaaataccggtaaattttttaccgcacttttattcatttcttggntaccagnattacatcccaagncgttatttgccgaatat

SEQ ID NO: 11 - DNA, 992 bp, H. influenzae
  misc_feature (958)..(958): n = a, c, g, or t
acatttattttacaacaacaagaaacagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccatatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactatcctcaatgggtatccgcgtagatgaaagtgcattacgtttacaagttggcttaacaggcgatgaaaaccgtttaaaatggattggcaccaagatttattaaacggggaaattgccattaactttcgcggtgggtatcgggtcaatctcgcttagcgatgcttttacttcgtaaaacatattgggggaagtgcaatcaagcgtatggccaaaagaatgttnaaaaaatttaaactttctttaaatcattaagtgg

SEQ ID NO: 12 - DNA, 1058 bp, H. influenzae
gagaccccatggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaattagaatatgaacaaaaagtgcggttaaaaataaccgcacttttcctttcatttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagtgcaatggaaacagcaatagggcggtttatattatcttgcaaatagccctagaagcatcttagatggcatttcagaaaatcttgttgataccaataaattacaaattgaaaacaaagtactacgccaacagcttttggaaaaaaatgcagatttactttaacttgatcaactcaagttgaaaatagcgattacgtcttttattaaatctccgttagaaccgatgatacaac

SEQ ID NO: 13 - DNA, 691 bp, H. influenzae
atgatgtggaagcgcagaaataataatttcaccgtcttcttgtttccaagttgcacgcatttttattgagccacgaccttgctcataaattttacgaatttctgattttggcgaaataatttccgcttctgttggaaaatctgggccttgaacaatttcaagtacatcatctaatctcgctttaggattatctagcaacattactgccgcatcagcaatttcgttaatattgtgtggtggaatatctgtggccatccccaccgcaatacctgttgtgccgttcaataaaatatgaggtaaacgagcaggtaaatattgtggttcagccaaggttccatcaaagtttggttgataatctactgttccttgtccgagttcactcaacaagatttcagagattttagataggcgagattccgtataacgcatggcagcgaaggattttggatcatctggtgccccccagttaccttgaccatctacaagcggataacgataagagaagggttgtgccattaacaccatagcttcataacaagcgctgtcaccatgtggatggaatttaccaagtacatcaccgacggtacgagcagattttttgtattttgccgtggcatttaagccaagttcagacatcgcatatacaatacgacgtgacgggtttagggtaccgagccgatatcgtatacag

SEQ ID NO: 14 - DNA, 1097 bp, H. influenzae
  misc_feature (960)..(960): n = a, c, g, or t
tggttccgaaattcggactcggtacccaaatgaaaaaccctcaacaaacagaaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcngcagcattagaaaaagcttaacgctttctagtgtattacaagacagcccgattctattcaaaacccggacaaaatgtggcacccgaaactccctgatcgtttgatggcccgagcgttaccgtaggatatgtcaatca

SEQ ID NO: 15 - DNA, 866 bp, H. influenzae
aagcattgaaaatatgatatcacaaagcctgtattttttaacaggcttttttgttcaaaaaaatcttcgaactgtttattcgttggagcaaaaatgaagtatgaattagataaaacaagcggcaatgctcgtcgtggtcgcttggtgtttgaacgtccacaaggcacgttcagtgtagaaacccctgcgtttatgccagtgggtacttatggcacggtaaaaggcatgacaccagaagaagtgcgtgcgacaggtgcagaaattttactgggtaacaccttccatttatggcttcgtccaggtcaagaaattatgcgtaaacacggtgatttgcacgattttatgcaatggcatcgtccgattttgactgacagtggcggtttccaagtattcagtttaggtaaattacgtaaaattaccgaagaaggcgtaaaattccaaaacccaattaacggtgagcgaatcttcctttcgcctgaaaaatccatggaaattcaatatgatttgggttctgatatcgtcatgatttttgatgaatgtacgccttacccagcgactttcgattatgcgaaaaaatctatggaaatgtcacttcgttgggcaaaacgcagccacgatcgctttgatgaattaggcaataaaaatgccctatttggtattatccaagggcggtgtatttgaagaattacgtaaagtctcattagaaggcttagtcaatattgggttttgacggttatgcggtggggcggttttagcggtaggcgaacccaaagaagatatgcaccgcatttttagatacatctgcccacaaaatccagctgacaaaccacgttatttaatggggcgtgggtaaaccagaagattaa

SEQ ID NO: 16 - DNA, 874 bp, H. influenzae
  misc_feature (627)..(627): n = a, c, g, or t
cttggttttaatgtaggttgtacagcaaatgcaggaattgcactgctcaaacacaccgataaccacgcataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctacagcttctgctttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatntttaatgggtttgcttcgccctcctaaacaaagcaaagaggaaatttttctgctaaataagtaatgatagcttttgcgttgttaaattttgcacttccgttggccatctgtaacttggaatgataatggcgcgccacccacaactatccccttggggctattaacacaaacacgaacgccttaatttacggcctccccacgaatttatttcggcccgctgtttggcggcaaattctcccacacatac

SEQ ID NO: 17 - DNA, 1230 bp, H. influenzae
  misc_feature (1210)..(1210): n = a, c, g, or t
acgaaatgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaaggtcttatcaatgactaaccccatttttgaaggacccaccttatttaggaagcgccgagaattatagggaactccctggagatctctaaagagatccaagagatgtcggcgataatggtggatatctttctctagatatttctggacggggaaaatagatttcaacgcagcgtgtgtgcatcgggggggacgtttagctgccttagttggtcccgtgttggtgtaggtgccctctgtggtgcggggccggggacccgacgggtcggcaggtcattgcggttgattccgtgtggcaatctggtgtgtgtcgagtctcgatcgcgctgacgttcgcggagttgggctcccctcgtctgcgcagcgcgtctcctggttggtgagcgggcactgcacactatgagatagcggcagaggcgcccgcgtgtttgggcacggtggtcgtcctcgatgacagcggttcggcctctctgcaggtgggcagctgtcagtcggtgggtggcggtagagggggggggacggtcgactgtgganggggggtgctgaggccgtgg

SEQ ID NO: 18 - DNA, 828 bp, H. influenzae
atagcaagcaacatccaccaacgttttataggaaattctcgttcactataaatattttgggcgtaagcatgttctaccgcatttgcaatcgcttcaatgtaactaggatatatccctttcacccccatacttttaagttcatctaatagtggctttgtgatttcgccatctgcactatcactataaacataatgccaacatttcacattttcttgagaagatgaagatgtataattaaaccctaaggatttatatagtcctatatgacaaaatatagcatcaacatcatagggaatatgtttacgatgatctgctggttttgattttggtcttacaatttgaaatttcaaggttctatattgcgattttatcgtatctaaaacagctattaaaacgctacaagcggcagcatcgataatatcagtgtcccgaaaatttagtttcaggcgacttcgacttcgtgctgctagttttgctttttcttcgagctcttctttaaatgctacaaattcataccctatttctttagctaaaataattttatatggggcgataacctcaaaaagattaaaggatttatgagcaagatgtttatatttaggctttccgcctctttgtctgattttcttttctttacttgtgagagctcgtaatgttctttgtctaacaatagatctccataatcgaatatccatagttggttccttgggtaacttatgtagaagtcgttttagttattatgttttcatataataatactgaataccaaaacactttccctaacacagaaattgctgtaggggtaccgaggctgatattcgtataaca

SEQ ID NO: 19 - DNA, 870 bp, H. influenzae
  misc_feature (827)..(827): n = a, c, g, or t
  misc_feature (839)..(839): n = a, c, g, or t
tttgcaagtatcccttatcagcaacgtcagcttgcagcacagctcaatttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcacctttcataataatatgcgttattacgaaatntgtggggtctcntagagtcgacctgcaggcagccaagtctggc

SEQ ID NO: 20 - DNA, 1294 bp, H. influenzae
  misc_feature (1226)..(1226): n = a, c, g, or t
aaaatcgcaacattatgaagcgtcaattgcagcttcttttttcaccaaaccaccagcctttcctaatgcaggaactggtttttcatgcttagtaatgatgttgataccttcaacaaacactttaccgtttggtaacactttagttaccttgccacgcttgcccttatctttaccagtaagaacaattacttcatcattttgacggattttagcagccattacattccccttacagtacttctggagctaaagaaatgatcttcatgaatttctcagaacgaagttcacgagtcactggtccaaaaatacgagtaccgattggttgctcagtgttattatttaaaattacacaagcgttaccatcgaaacgaataactgagccatctgggcgacgaacacccttcttggtgcgcacaacaactgcttttaatacatcacctttttttactttaccgcgtggaattgcttcttttacagtaattttgatgatgtcaccaatcgcagcataacgacggtgcgatccacctagaaccttgatacacattacgctgcgagcgcctgaattatcagcaacatccagcatagtctgttcttggatcatattagtgctccgttaagattaaaaaaacaccctttcgggacgaacccatccacactattcagatagaatggcagataggcggcggattttatcaaaagaaaaagagaaaggcaatgataatttagcttcctcttattgatctatttactaaataatccagttaaaatttaccgcacttttggaattataaaaatatcctcatcctctcaaaaatttatcgaatgaaaaataaactgcagaaaaaatgaaacgctctcttctcttaccttagataaattcatcagttttcagattttgggaaaatttccttgcctaaaagccaaagatacagatcgagctcttttaagttaaatctttctaatttataaaatctttgaaaatctatcaaaatctctttaaattttctgtaattttttaaatctttccttttaaaggctgaaaatttatctactttattaaaatagaggagatcttgctccacatagctatcataaattgggaaagcaattggattatgatgactacaatatttagttgcaaaagagtaaaaatacttctccttaccaccaattgttacttctcctaattcacgaactaattcaatatcaccagattttaaacgttnatctaagatctttataccccaaatatgctttgcaacatgatgaatagcaaatatattgtactataaac

SEQ ID NO: 21 - DNA, 994 bp, H. influenzae
agcttgctgcctgcggtcgactctaggagaccccagttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacattataaatattgttctaaatcatatttcttctatttttctaaaatcacactaatctaaacttgttaaataaacacaaactggttaaaatccaaccgataaggaaaatactgttttatgctaaagggtttactttaattgtcgttgaactcacaattgatataaaagataaaacagagaaaaaaatagtcacaaaggttaccaaggcaccgtgggtgtgaaatattcttggaaataatattccaaaaaataagggctgattttaaatatcagccctttgctttgatggtacattttattccaccacagcccaaaattcagcaacggtgtggaaagatccaaagactaaaaccacatcattttttaccgcacttttgagtgctgtacacacaccatccataacagaattatctgatgtagcttgaatatttgggaaatgacttttcaatttctctgctaattcatcgcctgactgcccgcgatagccgcctaaagttacacaatgccattcatcaataataggtgttaaatgctcaaataccccatttgcatctttgtctttgagcatcccacacacggcaatcattttaccctcgatgctacgtttaagtgcggtcatttttcagataaatatttgcaggggtaccgagtctgatattcgtataccag

SEQ ID NO: 22 - DNA, 874 bp, H. influenzae
cacttcttccgttgcatttaacttaatctccaatggagaagcgagcaaaaagtcaaaataagtatcccaaattaaatccttttgcacattaatatctttaacaaaatcaatttgctgtaaagtttctacaataagattttcgtgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttatcaaaatatgatcaattcgtaaacctcgattatcatcaaaacctttagaacggtaatcaaaccacgagaatttatcatttgctggtggggtcagcttacgaaaactatcttctaatccataatcatacaaacgttgataccacgctctttcttcaggtaagaaagacatttacctgggcgtaaccacgtttacgaatttatctcccataccatatttaaatacttgggcaatattatatagcccatattaaaatggataaactgggcggtgcttttttaaaactgtgaaaatcgctaaattcttttactgaaataactca

SEQ ID NO: 23 - DNA, 704 bp, H. influenzae
tagtgctaaatggaatgtagataatgatattattccaatgtctgttgcggatatggatattccagcccctcagataatgatagatgaattagaaaaatttaatcgtttaggaatttatggttatactgaattaccagccgactattacaagataatcagtgattatattttcgaacaatatcattattctgttctctctgaaaaaattgtattttgcccaagaataatccaagccgtatctatttatatacgagcatttacaaaagaaaatgatggaatatgtattctatcaccttcatatagtccaatattaaacacgataaaattaaatgacagaaaattatatcaatgtcctttggtttatgaaaatagaaagtatcatattgattttcatttattagaggaatgttttaaacattctaaagtatttgttttaatttctcctcataatccaactggaacgatttggaataaagaagtccttattaaaattataaacttagctaaaaaacataatgtatttatcatttccgatgatgtccacgcagactttacactaacaaatgactcccactatttaatatcatcattagatgaatgggtagcaaatcactcaatgatctgtttatccccagcaaaaacttttaatattccctggattggaaatagctaaccgggtaccgaggctgatattcgtataccag

SEQ ID NO: 24 - DNA, 1188 bp, H. influenzae
  misc_feature (1180)..(1180): n = a, c, g, or t
gaaaattatcgtaatgacttatgttttaatatgaatagatctttttcctctcaaacggggcttgatgttcgttcagaaaatacagggattgttaaatagcctacagttataaatagatcaaataactatttttttaatcaaaagtgcggtactataaataaaccaacattaacgaagtccaacgaaagggaaatattatgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaaattagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgagggataaacaaaaaagataaggagtaccgagtccgaatncgaaaaca

SEQ ID NO: 25 - DNA, 889 bp, H. influenzae
  misc_feature (880)..(880): n = a, c, g, or t
gttaccgcccagcattccgttcccaaaccatccctaaaattgccccagcaagaagcatgatgtcaggatcggtaagttgtgagtaaaccacgatacttatcactgcgcctaattggaaaagtaagaaacttggtttgcgtccgattcggtcggcgagttgtccgaaaatccaaatgccagccatcatgccgcagacggtaacggcggtccaaagcccagatttagttaaactgaatccaagttgttttgataagaaattaggtaaccaaatcataatgccgtaataaccgaagttttgtacaggaagtgagtacgacgataccaagactaattttgctcgtggctttgtctttaatcagaagctggaatgaacgtaatttatcagtaaagctggattgcgttgaaagtgcggtttgttttttagtgaaaatttcaggttcgtgcagatgagaacgtaagaaccaagcgacaaatgcagggaagatacccactaagaacattccacgccagccaatatgcgggagcaataatggtgtaagcaacgcagcacctaacacaccaacttgccaacccaatgcaacataagatgctgctttcgctcggtggcgtgcaggccatgcttctgctgctagagccatcccaattccaaattcaccgcctaagccaataccagcaattgtgcgataaatcagtaaatcccaataaccttgtgcaatcgcacataaaccagtaaacaccgcaaaaagaagaatagtccaagtcagtacgcgtacacgaccgtatttatcgcttaatgcaccaaataaaatgccgccaaatacggcaccaatcagagtccaagttacgagagatccacctgggcgggtgttagatttaagtntgcggaaat

SEQ ID NO: 26 - DNA, 1379 bp, H. influenzae
  misc_feature (1040)..(1040): n = a, c, g, or t
tgttttcggatatcagcctcggtactcatctacaggtgcaactggaattgccattgcctgtgcaactttcggtttagtattcggtggtatcatcggtggtcctgtcgctcgtttcttattaaatcgccaaaaacaaggcgaaaatcctgaaaatgatgaagttgatgacattcaagaagcatttgaacacccaacttataaacgtaaaattactgcacgttcattaattgaaacaattgcaatgatttcagtatgtttattaattggtcaatatttagatgtacaaacaaaaggtactgcactccaattaccaactttcgtatggtgtttattcactggtgttattgtccgcaatattttaagcaacattttccgtttccaagtagcagaatccgctattgacgtattaggtagcgtaggcttatccatctttttagcaattgctttaatgtcattaagactttgggaacttgcaggtttagcaattgatgtattaattgttcttgctattcaagtcgcatttatggctgcctttgcaatcttcattacttatcgagcaatgggtaaagattacgatgccgtcgtattaagtgctggacactgtggttttggtttaggcgcaaccccaacagcaatcgctaatatgcaagctgttaccagccgttttggaccatcacacaaagcatttttaatcgttccaatggtgggtgcattctttatcgacttaatcaacgcagcattattgaaagtctcatttgcagttgtaaatatgctcgcgtaaagtgcggttgaaattgacaatattttaaaaaatgcctttatcttaaattgataaaggcatttatttcaatataatcaattatttcagctgcaatatcaaccccacttgttttttcaatcatttctaagcctgggcttgcatttacttctaaaaccaataatccattttttgaacgaattaaatccacaccagccacatctaaaccgatggcttttgttgctctaatggctatctgtttctcgtcatcgcttagtataantttttcagtttttccaccacgatgacaattcgctcgaaactcgccatcttgtccgattcgttgcatcgttgcttcaacttgatcaccaattacaaaacacgaatattcgcattgcccgcttcttcattaaatcttgctgcaacataaatatattagtttgcttaaaagctccatattgctcaccggactttgtggcttttagctaaattaccccatttcttgggacccattagcattttaaattgcggcaaactgtattgagaatgccgcttgatttgactttaccgcccttataatgattggaacaggacaccaccttacagaagtgcaacttttcct

SEQ ID NO: 27 - DNA, 958 bp, H. influenzae
ctctttctgtttaatcgttaaattgggtaaatcctttaatcgattcaattttcttaacgtacattctagcttccgctcaagaatctgcttaatagaaagaataatcaattttctacacaatctattactacgtaaaatctgatcagaaagtgcataatattgtgaaagcacaaaccgtttattcaattcattcgttgtaaaaggttcacaacctaatttagttaattgaattgcgagaacaccctcaccgcgtaaataaagttttttattttgccaaatagcaaacattgtctcttccttgtgaaacaaaccgtaaccagtaaaaagatttttaaaggaaacatttcctactaactgatctaacaaggagcaaacgctatctatatgctcatcctttatattcatattaaacctccaatgaataattattttaaaagagtcagtagaagtacttctgatttcatttatatcatgaaatttttactacacctaaatataaatgtcagatttgtgagccagatcgtaaatttaaaatttatttttatctaaacgattggtttatatataaatatactatatttaaaactttttctgagattatttttgtatataatttaatctaattctctgttaaaaacttttattttaagccttccccatcctctttactgaaatatataccccatatttttttattaatataaatatttttcttgacctggacatcaatacagatataatcacaaaaatttgaacattcaaacaggattttaattatggcaactcaagaagaaaacaaaaagccctagcggctgcactaggggcaaatcgaaaaacaatttggtaaaggcttatttttgaattaggcgatcccaaacgttggatgagagtctatttttatggatcacttgggtacagttgcgttgggattggtgcttgccaatggctcaattgaaat

SEQ ID NO: 28 - DNA, 884 bp, H. influenzae
  misc_feature (736)..(736): n = a, c, g, or t
cggtttattcaaatcttctacgtcgccgttatacatatttccagcaccaatatactgatttgcgccttctaccaatgtttttacatattgagtaaagcgtttcggtatgtaagttttgttatcttcaaaggaataaattgaattgaaaaaagcattgaagaaataagagaaaaaggcggaacaattattccgccttaatttatttaatctatcattttaatagttatcatttttatctataatataaaaaccaagttaattactaggagataaaaatggcaaaagatgaagtagggcataattttcttgcacgtttgggtaaaacgcgtttgcgtccaggcggtaaaaaagcgacagattggttaattgctaatggcgattttagccaagataaaaaagtgttagaggttgcctgtaatatggggacgactgcaattggattggcgaaacaatttggttgtcatattgaaggtgttgatttagatgaaaatgcgttagcaaaagcacaagcaaatattgaagcaaatggcttgcaagaaaaaattcatgtacagcgtgcgaatgcgatgaagttgcctttcgaggatgaaagttttgatattgtcatcaatgaagcgatgctcacaatgttacccgtggaagcgaagaaaaagccattgcagaatattttcgagtgttaaaacccaatggtttattgcttactcacgatgttatgctggtggggaatgatcatcanactattctagaaaatatgcgcaaagccgataatgtgactgtcacgccattaacgaaagatggatggaaaagcatattccaagaaagtggcttttaaaatgttgatactttctctggggaggagacattactttcttcaaaggaaagac

SEQ ID NO: 29 - DNA, 871 bp, H. influenzae
  misc_feature (638)..(638): n = a, c, g, or t
acatttatcagtattgtatttggttcatattgattaagtgtaataaaccacgtttgcttttcaatccctttagccaattttgctacctgtaaaataagcaagacatctttatgcaatacggatataagttcttgcagatttttctgcaaaagtgcggtgaaattttcaggtaaattcaagcttagtatttgtttactaaaaaacaaccctatagattgacaagattctataagttgcgcccaatcagtttggctatcaacctgaatagtatttttttcatcaaaaccttgctggtttgccacttgacaaagtgtatcctcagtttcactaagtaataaaggatcttgcccttgcaagagataaactctagccaagctttgcgcaagatgatgatttagttgctctggaaaaatgcggttcattatttcctttttatttgattttgtaacgcaattatttttacgattaattgacgcgctacttgctcgcgcatatcattccaaattacctctcgttcttctgatttggctaatgctgcacgtgcattatcaaagaaagtacggtttactttcgcattgattggatagctttcgccattagcaaggcggaaagtggcttctacttccaacattaaaagnttttctgcctcacgtccgtgcttaaaaatagacgcaacttgatctgaagtaatctggttattaataccgaaaatgggaatattttgttctaattggcgacattaacctgatttcctgcaatttggacgcatataacagaaaaccattatagaagtatcctttcaaggctaatgtcgcctttatttggcaagaaccggatgtgaaaaagccaccccaacaaaagaattcctata

SEQ ID NO: 30 - DNA, 1343 bp, H. influenzae
  misc_feature (1069)..(1069): n = a, c, g, or t
gatatccccaatattgtactgattgggtaatctatctaaaagatacataaagaataataagaagatagtaaaagaatttttcaatgagtatattccattattagatattactgaaagtgatggaacttatttactttggataaactataaaaagctaagtataaatgaaaatgaattagcttattggattaataatttatcaagagtaaaagtatctttggggagtgaatttggcaaagagggagatggtttctttcgtatgaatgtcgctatgcctagaaaaaaattattagaagcattgaatcgaatcaaaaatgggttttgtttattaaacaatagggagatttaatatgaaaaccactcatcgcacaagaatgccaacaacattagaagctttttcaccaatcattgtgatgctattactgttagggcttgggtatgctttatttgatttgccagcagagccattaatgattatttcaacggtatttgctggttttttagttattaaattaggtcattgctatttagatattttagacgccatttcagaaaaaatagctaaaacaatgcctgcgctattaattttaattactgtaggattattaattggaacttggattagtggaggaacaattcctatgatgatctactacggactaaaagcaatatcaccagaatatctttatgtgacagccttattccttactgctattgtttccatttgtactggaacctcttgggggtcagcagggactgtcggtgtggcatttatgggagttgcgattggattagacgccaatttggctgctacggcaggtgctgtggtcgctggtgcgtattttggagataaattatcgccattatctgatacaaccaatattgcatccgcagctgctggcgtagatttatatgagcatatagttcacttactttatacaacattaccatcttttattctttcggctactgtctatgtggtatatggtttaaactacgatttttctaatgtagcgactccagaaaaagtaaatacaatgattcatgagttagagcaagtttatcattntaactttctattacttattccagtcgctattgtattatgggggatctattactaagaaaccgactattccagtgatgttattatcagcatttatcgcaattattaatgctatcttaattcaaaattctctctatctgatgtgattataagcgcaggtaatggaattgatacctcaatgattcaccatacttcagttagctctgaattaagccgtttggtgaatccggggggaaagaactcatggatgggaacactataaatgggttctgggcat

SEQ ID NO: 31 - DNA, 1080 bp, H. influenzae
ttaaacaagtttgtatagttttcaatagtaattgggaatgcataagagttgctaccatctcgagtcagaaaacttacggcaagtaccaataagtttggaatcagcacaaagaagattagccaactgaagataatcgcaacagtaattttctggaatttattattgattatcttcatcgttgagtacaacctccccagccttcgtgccatgtgatacctacgcgttgtcctatgctatgatccatatgtggatcatcttcattaaagaattcacttacaaggacacgcattccgttatgatcaaactctaccgttgattctaatgtcattcctttataagtgcggtcaataatatgaccgataattgctttagaatgttcattttcatctaattcttcaatcacaatatcttcagggcgaaggagtacttgaagtttttgatctttttccacaggcatatccgtataaatatcacaaatacgaccttcaacatttgccagtacaacttgttctgattttcgttcaatcacagtggcttcaaatacgttaatttcgccaatgaaacgagcaacgaataagttagctggatcttcatagatttcacgtggagaaccatcctgtgcgattttacctttacgcaataatacaatacgatcagacattgtaatcgcttcttcttgatcgtgggtgacaaaaataaaggtaatgccaagctgacgttgtaacattttgagttcttgttgcatttgtttacgcaatttgtaatccattgcagataaagactcatcaagtaacaacactttttggtttatttactacggcacgagcgatagcaatacgttgttggttgtccgccaaaaagttgagttgttttaccaccggcattttttgtagtggaccattacccaggcttctaaacacgcgggttaattccctgttcggtacttttgccaacccacaccgaaggccggtgttcaaaatggtccatggcgaaatacccctactttcgaataccgctaaacaagccgtactcccctggccacctggcgtattttcccacttcatatcgttccccttcctc

SEQ ID NO: 32 - DNA, 893 bp, H. influenzae
ggaattcggactcggtacccgcagaagaaaatgaaacgctatgcaatttcttatcacttcgacggcaaaaggtgggcgacagatgtttacgcccattcattcgaagaagcggaagaaaagctaaaagcaatgtcccaaggtactgttgacggcgagattcacctttcagtttacattcctgaaaatccgctatcgaaagtatcaaggttgattacaagaatagctaaaaagtttatgtaagtcagtgactttcatcacaaattttaaacaatttggttaaagaaactcactcggcggaagcgcagacggaagcccaacggtgctaagcggtcgttagattgaaagccctaacctacttagttaagagtgagttttaaagtctgcccatgcaaagccaatgaaaaacggtgcagttgccgaaagtggagctcaagcaggcgaatatcccaatgtggatatttcaaaacacatttgctagtacagagacacaacggcatgtgaaaccgttgcgaatgatagatgaagtgtgttttgaaatggcagacataaaacaaacgaggttcaaatatggaagaaaaacaagaaaaaagcctatctgataaagataaaaatctaatcaaacaggctgtattagaaagtgctgataaaaatacaaatttaacaccaagtgaattagctgagagtgtatgttcggcagtgatgtttattgattcttatgggcgttaaaatatctgaactgggaatgctatcatcaatagattcttgcaatcttgatgataatgttgaaaacaaattgtcaatatcttcggccacatactcattaacttctcgcaaaaattgaaagtttgtttttaaatatctcttggcctatacagaagctttttatctgctga

SEQ ID NO: 33 - DNA, 1690 bp, H. influenzae
  misc_feature (559)..(559): n = a, c, g, or t
  misc_feature (727)..(727): n = a, c, g, or t
  misc_feature (1640)..(1640): n = a, c, g, or t
gattcggctcgtaccctctacaaaataatcctgttacattattctcctaataagattctaaaagtctctcgatcatatatatctgcttctgtatccaaatcattttcatcataaaactctgtgatgccaatctcctcttcttgataaggaagatcatgtattaatatatacttcattgtatcagataaatgacaccaccaatcccaatcttcattagaaatattcccagtagtatctgtatcattgataagttcttctgggaatttatcctctgctaattttgacgtttctttacgggtatcaacgccgttgatgaaattaattaatctatgtcccaaataacgagtattccactcatcagaatattcaaaaccaagatcttcagaaatttctcttaagtaccattattaaaaatatttttttcagtatttgtttaggtgttatgtcaataacacctaaaagaaaaagtgcggttaaaattcattgaattttaaccgcactttaaaaacaaaaaagccaatagatttacactattggcttttattttattactctttgntattaattaagcaataactgctttctcaacaacacgaactaaagtccaagatttggtttttgatagagggcgacattcgcgaatctctacggtatcaccaactttggcttcattgttctcatcgtgtacgtgtaatttagttgtacgacggataaatttaccatatanaggggtgttttacccttacgttccaatagcaacaacgaaagaattttccatttttggcgctaacaactttaccttgtacgctacgaattttatcagtcattactcacccgccttttcggttaatacagtttttacacgtgcaatatcacgacgcacttgcttagcctgatgggtttgttgaagctgaccggtggctgtctgcatacgcaacttgaattgttcacctaaaaggtttactaattcagcattcagctcttcaacactttttgtacgtaattcttgagctttcattacatcaccgtcttagttacgaaagtggtcttaactggcaatttatcagctgctaatgcaaatgcgtttcttgctacttcttcagacacaccatccatttcataaagcactttacccggttggattaatgctacccagtactcaacgttacctttacctttacccatacggacttctaatggttcttcagtaattggtttatttgggaatacactaatccacattttaccttgtcttttttactgcacgtgacattgcacgacgttccgcttcgatccttctagcgtttaaaccacaacgaccttttgtttttatactctatgtttttttcctacctatattacccgtttgttttaccaccggctggggtgtttttgttaatttttatgcatttttcgtactccctgtttcgcttttcttcacgggtttccccgtctcctactaccctctttttctcttgtgcacttcttcttagtttccttgctaactgttgttctattttatttgtcgcatgcttcattttctttctcgcccatagcgcaccctcgtggttttctctctaatatttacattttattccccgccccgccctcggcgtttttttgtttcgcgtctttaatcngcctgcccgcgcaaccatttgttttcttgattttcttcttttctccctcg

SEQ ID NO: 34 - DNA, 1132 bp, H. influenzae
tggatcgattcggctggtaccccaccataacacatttttatctttaaattcagctttaatggtattcaatttgcgacgaacagaactaatacgctgtgcttgacctggcataataaaggtacgaccaacatagcgatttttcacaaatccttgtcgataaggcttccctagaacacgagctatttgtaacgcaatatctgtggaggtttcaggaataggaatgaccacatcaatattatcaatttcatccgcccattcttttgcaatttttttcccgagtttttcccccatatgaacacgtgccgcataaacagagacaccatcaatcgttgaatctgggcgtgcaaaataaacatactcaaaaatacaaggatttaacaccgcactttcggtacattgttgtgaataaagctcgccatcaaatgtcacataaacggcttcgcccgcagcaatatcacgcacaaactcgaaacccacaatatctaaagctactgtttcagaggcgaacatataatcagttttgccattttcttcacgtttacccaacaccaaaggacgaataccaaaaggatctctaaatgcaaccattccgtgtccaataatcatcgctacgcaggcataagcaccacgaatatcattgtgagttttacgaacagcatagaaaatatcttgtggatcaagatggttttgaggaatgtgatcaagatgattagcgagaatattaagaagaagttcagaatctgaattagtgtttacgtgacggcgggcagttttaaagactttttcttttaactccactgagttggttaaattgccggtatgcaccaaagtgacaccataggggagaatttacataaaaggttgtgcctctgagacgctagaacttcctgccgtaagatagcgaaaatgcccttatccagcattttcttgcaagcggaacatatgctctttgacggaacataatgctgactaagccattaactttacgtaagcggaaacgtgtttcataatcaatcgttacaataccctgcccgattttgtccaagaggttgccaaaagagtaatgctgcaataaaaaattattaacccggcatttggtaaaaaaacgcatataccccacattttgggttct

SEQ ID NO: 35 - DNA, 390 bp, H. influenzae
ttctgttaccgaattcggactcgtaccccgggaatccttttgcactagaattatttagagcatcttcagtaatttttatgttggtatcccaaatttctttaaaatctacttcttgagttcttaaccatggaatagtaccgttgtcataatagccattatttgatgttgtaggcgttccgcctgaagaaattttctttgagatttcatcaattgttttccactcaaacccaaccttcccaagttcttcttcacttaacaatttttcccgatagtattcatactgcttctgacgtagtataagctcgctggtaagctcgctggtaagtgctgtcaatgcgtccaaaatttttacgatttctgtttggacggagagtggggggatggggattg

SEQ ID NO: 36 - DNA, 870 bp, H. influenzae
  misc_feature (720)..(720): n = a, c, g, or t
acccaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatccgccttgtcttcttttgcaaaagaaggtaaagatgttcccgtcataaggatcactgcccccatgccagaaacaaagtttcggcgtgagcagactgtcattgtttatccttttgtttggttagtttatcttgttcagctttacgtttttgttgtttaccatggcaatctacgcaaagtttaacgcgttgttttggttgaatacctttcattgcgtcttctttagggtgaagcgtatggcaacttgcgcaaggcaatttcattgcgtgtacatcatgagcccataatttttcacgaagtttgtcaggttgatggcaagcaaaacaaacttggttttgttcttgaactgaatacatcggttttttattaccgaaaatatctccttcaaaacgcataacatctttagcaccgcgacgatgattttcggaaacattgccgtgacagcttacacaagtaatagctttaccgttatttggatttttcttatctaaatgtgcaccatggaatttaccanagtggagttcgccaccagaccgatctagcgtttggtttttatctattttgtcgaatttatggcatttagcacaatattgattaggatcgcgttggttatctaattgcggttcataagtaacatgatccgcagggtttgggcatatccgcc

SEQ ID NO: 37 - DNA, 890 bp, H. influenzae
  misc_feature (145)..(145): n = a, c, g, or t
gcccagacttggctggcctggcaggtcgactctaggaggaccccttcccaaagaaggtcctgtactttgggttgatacacttgcaattcctgtaacagctaaaaatcctgaaggcgcacacaagctgattaactacatgttaggngaaaaaaacagctgaaaaattaaccttagctatcggttacccaacctcaaatattgaagcgaaaaaagcattaccaaaagaaatcactgaagatccagcgatttatccgtcagctgatatattaaaaaatagtcactggcaagatgacgttggcgatgcaattcaattctatgaacaatattatcaagaattaaaagcagcaaaataattggtcaattagcaaagaattaaaatctgattctgtgcaatatttcctctaaataaaaacgccctttcgggcgttattttttaagctttaccgtcagccaaatttttcttttcttctaattcttcccagcgtaaaaatgctgtttctaattcggcttcagtatctgccaatgcttttaatttagcgtcggtaatatcgtgagcttgttggaaaaatgctggatcggctatttcagcttgaagtacggtgattttagtttccaactcttccaatagttgtggaagttgttctagttctcgttgttctttataagaaagtttcacggatttcggctttagaagtgcggtcatttttcaccgcactttcttcttttagtggttcagatttcttcgccttagcctgttcttccaccgctttgcttgcccaaaaattggcttgttgctgtttcgcatcaaagaatcctcccacatacttattcaaagccccttcacctttgaataataacatttggcgcaggattatcgataaatgaccgga

SEQ ID NO: 38 - DNA, 1065 bp, H. influenzae
  misc_feature (836)..(836): n = a, c, g, or t
  misc_feature (911)..(911): n = a, c, g, or t
  misc_feature (952)..(952): n = a, c, g, or t
  misc_feature (1015)..(1015): n = a, c, g, or t
  misc_feature (1022)..(1022): n = a, c, g, or t
  misc_feature (1030)..(1030): n = a, c, g, or t
tgttatacgaatatcggactcggtaccccttatattcttctttaaatcttcctcatttcttgtgctttttttaccatatcttctgaaccaacaaaaagtggaacacgttcatgaagtgcggttggttcgatatctaaaattcgacgataaccatctgttgcgacaccgccagcttgctccgctaaaaatgcaataggattgccttcatataataaacggagttttccatttggatagttggttgcacttggataaatataaatgccgccttttaataagttgcggtggaagtctgctacaagtgaaccaatatagcgagatacgtaagggcgatgagtcgctttatcttcttcttggcaatatttaatatattttttcacaccttgtgggaatttcaggtattgtccttcattgatggaataaattttgccctcttttggcatttgcatattttcgtgggaaagacagaatgtaccgatagacggatcataagtgaaaccattcacaccgtgaccagtggtataaaccaacattgttgatgaaccataaacaatataacccgaggcaacttgtttattacctggttgcataaaatcttctaaggtaacaggtgagccaataggggatacacgacggtaaatggagaaaattgtaccgacggatacgtttacatcaatatttgaagagccatcaaggggatccgttaaaataatatattttgcattacgaccacgttccgtatcaaatgcgataaaactttcctcttcttcagatgcaaacccagccacttcttcacgtgccattatggccgctttcatcgtgttatggggcgaaanaatcgagtttattttgactttcgccttgtacattttcataccagattgaccgagaatatttgtaacctggcttgntatatctcgatgaattatttcgctaaagacgatgacgacanatacactcattcccttagcattttggggatctggttggcgtcaacgaaatcaccttaaggttncatattncctttagntttctaaacatgatataaagggggggggggggggg

SEQ ID NO: 39 - DNA, 934 bp, H. influenzae
  misc_feature (828)..(828): n = a, c, g, or t
  misc_feature (850)..(850): n = a, c, g, or t
  misc_feature (886)..(888): n = a, c, g, or t
  misc_feature (897)..(897): n = a, c, g, or t
tgtatacgaatcggactcgtaccccggcttagatataaccacatgatcggaataaatccagctaagccaatcactgcagctaaaataagccaccagctcattcctgctaaaaacacgacaaataaacctgacgcactgaccaaaattgctgtgcctaaatcaggctgaatcgccacaagcaatgttggcagtagaatcattgcaatcgctataaatgtttcacttaatttaggtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaatcactgtcacaccaatctagggttttcataaggcgcantatgcgtaaaccatgcgtgatncatgcattctttttttcaatcccaccgcattggatnnnttcattttncttttaaactaaacacttgagcagtacccagatttcc

SEQ ID NO: 40 - DNA, 1244 bp, H. influenzae
  misc_feature (1098)..(1098): n = a, c, g, or t
  misc_feature (1111)..(1111): n = a, c, g, or t
  misc_feature (1120)..(1121): n = a, c, g, or t
  misc_feature (1123)..(1123): n = a, c, g, or t
ctggtatacgaatatcggactcggtaccctattgggggtgttgataaccttaaagcacccgtccttttgtgaatgttccgattatcggaattgtaaaacgtgatttgcctgatagtcccgtgcgtattacgccgtttttacaagatattgaagatctagccaatgcaggtgcggatattattgcagtagatggcacgagccgcccacgtcctgtggatattgaaagtgcggtgaaaaaaatccacgaaatgggctgtttggcaatggcagattgttctaatttagaagaaggcttgtattgtaaagcgcttggttttgatattgtcggcagtacgatgtcgggttatacaggtggcgcagtgccagaagaaccagattatcaattagtgaaagatttaaaatcagcgggttgttttgtgatggctgaggggcgttataacacaccagaattggcaaaagtggcaattgaaattggtgcagattgcgtgactgtaggttcagccttaactcgtcttgaacatattgtgagttggtttgctaattcagtgaaatctgcaagatagtcgtaagacgtgtgagaaaagactttacactataaggataagttatgcgttgtttagcactagatattggtgggacaaaaattgcagcggcgattgtaaaaaatggcgaaattgagcaacgtcagcaaattcatacaccacgtgaaaatgtcgtggagggaatgcaccaagcgttaggcaaattgcttgctgattatgaagggcagtttgattatgtagcggtagcatctacggggattatcaataatggtattttaagtgcattaaatccgaaaaacttaggtggcttggcggaatttccacttaaagcgagtattgcaaaacatacggataaaccgattggtttattaaatgatgcacaagctgcgacttatgcggaatatcaattgcaaaattttgaacaggtatcaaatttttgtttttattaccgtttcaacaggagttggcggaggggattgtgctgaaccaaattttgcagacagggttctcgtggtattgcagggcatattggtcatacattagctgatccaatggntgcgatctgtggntggtggcgnncnaaggttggtgtcaaagcgattgcttcagggcgagcattggaaacagtttcttccatggggaagacccggcgatcccaaagaatgtttgagcggttaaaaaaaatgatgaaaaacgaccgcc

SEQ ID NO: 41 - DNA, 958 bp, H. influenzae
  misc_feature (729)..(729): n = a, c, g, or t
  misc_feature (769)..(769): n = a, c, g, or t
ctgtatacgaatcggactcggtacccgtcattgcaatgcccctttcatcattgccatcaagctatcgcgcgccttatcagccttcgctttatcgtaaaaacttggctttgctggaatcatcttcggaatatcctcaaaaggaaaattcgaccgcactttttccgccgcttctgtgagtaatttcggaatagctttcaacgtgtcctcttccgattttttcttgcacttttcgtacagatttttaagcaaccaaaattccacttttgaacgatattgaaattcatcccgattgaatcgggcatagcctaagaaagtgttataacgttggtataattccgcttcgttcggtaaacctagtgcgtgatagtcgtaggctttgcaccaataaacgaacaaccctacgctaggtaaaaatttatcaagcgatttttccgcttcacaaatcccgttctccaactgaggtctcgtaattttttctcgtaccaacacacgcaaccaagtttttttagcagagagataatccgctttcggtttcaaaggctgcacgccaaccaggaaaaattgatttaagctcgttaaagagccagttaatcgtctcttccgcacgctgtgctcgttctggtgggagcgtgtaatttgggttttgtggtattggaatattgcattgcgtaccgtccactgtgaaattcattcctgcaaccagcctgtctgcgtatcgcaatttgggtntttggggggggggaaatggcccaaatgcgggaaattgggncccaggttttcatcacgccatccatgatgcgtaaaatcctgccggttgcgtcaatgcaaatctccacgctcacaatcgaaatccccgcttgccgcttgtttgcaagcggtgaaatgccttggttaatacccttttgcgttggcggggcgataaatcttcccagttgtcgtatacgactgtcagccattt

SEQ ID NO: 42 - DNA, 197 bp, H. influenzae
ctacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaag

SEQ ID NO: 43 - DNA, 944 bp, H. influenzae
agaagatatatgaatgaagagcaaattcttcatttcagaaaaatcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattagccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgttcggtggatgtatccgtgatttattgctcggtaaaaaaccaaagattttgatgttgcaacaaatgctcgcccagagcaaatccaaacatttttcaacgccatgtcggttagtgggtcgccgttttccgctagcacatataaggtttgtccgagaataatggaagccga

SEQ ID NO: 44 - DNA, 865 bp, H. influenzae
gagcttaattaggtggtggttaagggcattctacccctaaatttaatatggatatccgccgatatgtaaaatggtttgatggctttcccaaatcttattgcgcttattggattgcgaaaagtgatcatgaagaaacaaaagattattttcaacgttaaaaattaatcattatgatcaagatgaagtgataaaatagtgaaataaaaggtgctgttcagcaaattctgtgaaacaacacctttatttttctattttttaatcagcactataatataattttccgatttcaattttttgacgacccgtctcttctcgccatttattactatcacgtaaagaatacacacaaccgcaatattcctgttgataaaaccgctcacgcttactaatttcaatcatacgctgtgaaccaccttccttgcgccagttataatcccaataaactacatcatcatatttttccgcagctcgatgcccacagccattgatttgattcatatccttccagcgagaaattcccaagcaactagtaaatacagggaaaccatgttcatgagcatattcagcagctttttcaaagcgcatatcaaaacacattgtgcagcgaatacctctctcaggctcccattccatacccttagcacgatcaaaccaattttgacgatcgtaatcagcatcaataaatggaataccaaatttttttgcaaaacggatattttcttctttacgaatcaaatattctttgagtggatgaatgtttggattgtaaaaataaatcgtaaattcaatgcctgatgcaagaattgcttccatcacttcgccagagcaaggcgcacaacaagaatgcaaaaggagcttattgtgt

SEQ ID NO: 45 - DNA, 905 bp, H. influenzae
accccgtacacgttgaaccatattttcgctgtacgcaccataaccttcttcaggttgtacacgtacttcaaatttgtcgccaacttctttaccttcaagtgctttttcaagaccgactactaaattattgtgaccttgtaaatattctagtggttgatttgctggagcttcatctaccaatacgccatcttgtgtgcgaacttggtaagaaatgctcaccactacatttttttctactttcattatgttttccttataaaaatcggttaaaaagccgtatcattgtaacgaaaattattccacgcgcaagactttacggattaatgaacacgaggctcttcttcatcttcatcatcaaaaaattccccatcgtcaccgtattcatcgtcatcggcatttgggtcttcaaaataggtgccccaaccatcataaatgcctttatgtttttctaacaatggaaggatttgtttttgttgtgcatcgataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcgatgtgatgctcaataatgtaaagcgcatttggatcactgccatcattaagtaaatcttcgataatttcacgggtttctgcttgtaattcagcccattttgacataataaaatcctttcacagaacaaaagtgcggttattttagtggataaatcaccaaaagtcgcatagaatttcgcacaattattttcctaaaaaagaaccttaaccatgctcgaacactcccttatttgcataaaaactcgcaaaaccacgacttttaggctg

SEQ ID NO: 46 - DNA, 907 bp, H. influenzae
  misc_feature (658)..(658): n = a, c, g, or t
  misc_feature (784)..(784): n = a, c, g, or t
  misc_feature (791)..(791): n = a, c, g, or t
  misc_feature (825)..(825): n = a, c, g, or t
gtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatttaatcacgaggtttagaaaatggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgggacgcacgtcgcgttgaacgtanaaaagtggggttacacaaagcacgtcgtcgtccacatactcaaaacgttaattttattttcgtttccaaagaaagcagagagaatctctgctttttattatttgagtactctacttattgatatanaacatanaaagatatggtggcaaatagtaatgctttatggnaaaagttgccccttaaaactaaatattttggatcttcgaggataaaggccacccatcagaacgtcagaatgaccctttttaa

SEQ ID NO: 47 - DNA, 1007 bp, H. influenzae
aaaccaactatttacagaataaacacctgaaactttttcacgtagaattaagcgtaatttttcttgcacaatatcagcaagaatattgaataagtatttttgttccgctcgccaagtattatctgcggtaaggtatatttctacatcagctctcggttctttcaaaccattcataataaatgattgagttggtgtatgaataatagtagggacaaagtgacgtatctgagtttttgattcaacagaagctaaataacgttctgccaatttctttacttgattaagctcaatatcgccaataataaaataggtaaaatctgttttatttaaaatataacgttgataagcgttacttaattggtttttatcaaatgctaattgctgtgcttgtttttgagtatagacagtttcaatatttggaaaacgcagttttgaaacggcttgcataaattgtgtttctaaatcaatctgtttgaaataatcacgggtttcacgtcgatatttttctaaggcaagatcggatataggcgaagaacgtaattttaagcggaacaatgtcagtaaattttccaaatctttagggttagatacaccagtaaaaccttgtttatcatcatcaatcacagttgcaattaccaatggatcacgcgaaaaaatttgattaaccgcagaaagagaaagttctccaacacctggtttcatcaactacactaacggcagcacgcaataagtgatagtcccttttctgggataaaacgcaaacccacctttgggtaacagccccgaaaatgtccctggatttggaggtttggcactataggggggaaatcattttacttcctttctttaaagaaatttttaatattcgccccgattcccgtatttttctttggaaatatgacccgggtaaaatgttataggcggaattttcccatttgtgttttttttcacatggggttgtggatttctattgtgtgtcccacatttttttctttatatcaaaggag

SEQ ID NO: 48 - DNA, 749 bp, H. influenzae
agcagcttgctgcctgcagtcgactctaaaggaccccactacaaaaatgggtagcgatgtggcaataaagtcataatttcttttgattcgatcactcttggttgttgttctgacacgttgataccttacaaaaaataaacaaataaaatctgtcggattatacgatatttatagctaaaaataaaacgtactcaatatgctccgtgtttaggacgaatatcaatggctggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatctgagaaataaatcattgagaaagtgcggtgatttttcttcgcattttcttcaagctgatcatatacacgttttaaaaattcatcggttttcttaatagacgacacatagcaatttaaataaccatatttcggattaagatctttatcatcaaaaatttttggataatcttcgatacgatcgcaagccattgggtgtgaaccataaatatgcaacacaataaa

SEQ ID NO: 49 - DNA, 664 bp, H. influenzae
tggtttcggatatcagactcggtactttacctgttggtttttctctttgctctgctaattctaatgatgctttaatacgagcttgttttttcgatttttcacgaatagcaactacatcatttacagaaacttggaaagatggaatattaacaacacgaccattcacaacaattgctttatgactcactaattgacgagcctctgcacgagttgcagcaaatcccatgcgataaacaacgttatccaatctaccttctaataacactaataaattttcaccagtgttacctttcaaacggtttgcttctttatagtagttacggaattgacgttctaaaataccatagatacgacgaactttttgtttttcacgtaactgactaccatagtcagacaaacgcggtttacgagcaccgtgctgacctggtgctgtatcaattttacattttgaatcaatcgcacgcacgcctgatttaaggaataaatcagtgccttcacgacggctgagcttgagtttaggacccaaatatcttgccattttctttctccaactatcctatacgtcttaaacacgacgttttttcggtggacgacaaccgttatgaggaatcggagtcacatcagtaatattcgtgatacggaaacccgctgcgtttaacgcacg

SEQ ID NO: 50 - DNA, 986 bp, H. influenzae
attaggtgcagattcattagacacagttgaattagtaatggctttagaagaagaatttgatattgaaattcctgatgaagaagctgaaaaaattaccactgttcaatctgcgattgattacgtgcaaaacaatcaataattttaagttgggcgacgttttaagtcgcctaatttttttctaataatcctctttaaaattaccgcactttttatttttccctttcataaacattgatctaaattatcttttacttaaaatcttggtttaaattttaaaaaattatttagttatatgcctaaaaagaagtattatttgcatagtttttcatttttgaggtgtttatgctttacttagaatttttatttttactattaatgctttatatcggtagccgttacggcggtatcggattaggtgttgtttctggtatcggtcttgctatcgaggttttcgtatttcgtatgccagtggggaaagcaccgattgatgttatgcttatcattcttgcggtggtgacttgcgcatccgtacttgaagcagctggcggtttgaaatttatgttacaaattgctgaacgcattctccgtaaaaatccaaaacgtgtcactttactcggcccattagtcgtctatttattaacctttatgcttggtactggtcactctgtttacacaattatgccaatcatcggcgatgttgcattgaaaaacaaaattcgtccagaacgtccaatggcagcgtcttcggtagcatcgcaattagccatcacatcaagcccactttctgcagctggtgtattttatctaggtaaaaatacagcaatgcccgcttttgagcatattagtttattagatattatttgtgtaaccgtttctgctactttagcgggtacgaatgcgcctttcttatacagtaatgcgcgggggaaaagaagtagcacaagatcctcgatattcacgttgtttaccagatccactattgccga

SEQ ID NO: 51 - DNA, 974 bp, H. influenzae
  misc_feature (775)..(775): n = a, c, g, or t
  misc_feature (813)..(813): n = a, c, g, or t
  misc_feature (866)..(866): n = a, c, g, or t
ctgttaccgaaatcggactcggtacccaggattcagctggtgttgcagtaatcaataaacaaaatgaattacaacgtattcgttgtttaggcaaagttaaagctttagatgaagccgtatcagaaaaaccattaattggtggaacgggaattgcacatactcgctgggcaactcacggcgaaccatcagaaactaatgcgcatccgcattcatcaggtacttttgctgtagtacataacggtattattgaaaatcacgaagaacttcgcgaattattaaaatctcgtggttatgtctttttatcacaaacagatactgaagtgatcgctcacctcgttgaatgggaaatgcgtagcacggattcccttttagaggctgtgcagaaatcggtaaaacaactcacgggcgcatatggtatggtggtaatggacagccgtcatcctgaacatttagtggcagctcgttctgggtagtccacttgtgattggcttaggtatcgggtgaaaatttcttagcttcagatcaacttgcgcttttaagtgttactcgccgttttatctttttagaagaaggagatattgcagatattacacgtcgtacagttgatatttatgatactcacggtaataaggctaaacgtgaaattcacgagtctaatcttgaaaatgacgctgcagagaaaggaaaaatccgccattttatgcagaaagaaatttacgaacagccaactgcacttattaatacaatggaaggggcgtattaatcacgaaatggngaatggtgattcaatcggaatggggcaaaagcatttanaaaaaagtgagcatatcaaattgtgcttgtggacatctataatgcagtatgtngcgcgttatgggtttgaaacttaactgcgggagctgggagttgaaatgcatcaaatttcgtatcgcaattggtacccggccaaaagctaatgatacccttctcattgg

SEQ ID NO: 52 - DNA, 925 bp, H. influenzae
  misc_feature (705)..(705): n = a, c, g, or t
  misc_feature (826)..(826): n = a, c, g, or t
aaaagttcaatcatagatagtaacaaccataaggaatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactggtgcaggagaatgttatccacaaaaatcagcatggcgttcaggttggtgcaaatatgatgcaaacacattattgcagtattgcttatggncgtacaattatagagaagatattgttgacccagattagggtaaaaacaacaagtaaacgggcgctttcactttaggctatcgttaaggattaagcttattagggcctaaatagggcttgcnaaactaaaactttaagataaccgaaaaagcctttcgaattccaggtttcaatgaattagggaaaactatgttttggcactcaaatgaaccgatctgaat

SEQ ID NO: 53 - DNA, 1156 bp, H. influenzae
  misc_feature (609)..(609): n = a, c, g, or t
  misc_feature (926)..(926): n = a, c, g, or t
tgtatacgatatcgactcggtaccctttcaaaaacgctctaaaattgaccgcactttaaatataataatcaagctcaagtggtatttttgcttgtaacaagaactgtttagtgcgctcgtgttgtgggcaagtgaagaatttatctgccgtattttgttctacaatatatccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgatgaacgtcggcgtaacttcaattcatctgctttactaattntctggctaaaatcaatttttagactgccatcagtaaattccaaaatgccttgctctggtcgttcaagcaagtttaaacaacgtaaaaaggtgggttttttccagaacccagagggcctaaaattgcgaccacttcacctttattaatttcaaaatcaatgccttttaacacatgattgccattaaagtttttctgaatattacttacttttaacatagacattcctttataatggcgagataagcgaatttcaagacgatctttgtagaatagataaacaaacagaaatatccataaatcaagctgcctcactatanattaaataaattcatagtcgctgccgtatattctgtgcgacacggatatttctgtcctaaacaggagagctatggagtggcttcactggactataaaagatagaagcgagggcctgaatacgaaagcctgggcataatgaccaaaatgctggcgatattctactatcgctaagagcttccactgctttagttagcataattgagcccaacagttctgtgctaaccctatt

SEQ ID NO: 54 - DNA, 1520 bp, H. influenzae
cttaaatcgccatttgcagatttaataaaaaattaaagtctcttggaatttttcctcctaaaaacgaaaaaatggaaacccttctatgggattccattcatcgttaaaagtcttaaagcctaaatttgtgtcagtcacttacggcgcaaatcgggagaacgtgaccgcactcacggcattgtgaaagccattaaacaagaaacgggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcctgaagttcatccagaagcaaaatccgcacaagcagacttaattaatttaaaacgtaaaattgattcaggtgcaaaccacgtcattatacaatttttctttgatattgaaaactacctacgttttcgtgatcgttgtgcatcaattggtattgatactgaaatcgtacccggtattttacctgttactaattttaaacaactccaaaaaatggcatcattcactaatgtgaaaattccagcgtggttagttaaagcctatgatggtttggatgatgatccaactacacgtaatcttgtagcagcaagtgttgcaatggatatggtaaaaattttatctcgcgaaggcgtgaatgacttccacttttatacattaaatcgtagtgaattaacttatgctatctgtcatatgttaggtgtaagaccttaattatcacaataatatatttcttttcaaacacaaaataagggcgatatttcgcccttatacaaaactaaaaaaattcaaccgcactttattattttatgaactctgtttgcatatacattaatcgatctatattcgttaaataatgccctaattcttgctcttcggctttatgtaaataaggaattttacctaaaactggcgcattaatatgttcaaccagtaaatcaacaatttctgcataatggcttaataatgcattaattcgacttgtattcaacctaataacggcccacccaacctgttggataacctttattgtcaataaagcgtgatttacacaagcatctttaattcccactctaagtattactggcttattcggctatatattctacctgattaccttttttcttctgccatttgggttataaacacaaatatttttccccccccctaatgctttttctggtttatttgtgtcttttctattatttttccttttttactgtcgattcatttccccgcgcccgcgagcttttttggtcatacgttattatctttcccccgaccagacaaatctcattattgttgagtactcgcatcagctcacatattctctccctatgacccgcttattcattttgctcttcggccttcggttaatatttcgatgt

SEQ ID NO: 55 - DNA, 983 bp, H. influenzae
  misc_feature (941)..(941): n = a, c, g, or t
ttatcgattcggctcggtaccctatcagtaaattacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattaccaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatctgtgccaacaattacccgagattctaaaattaaatcgccatcacgataatactgtaatttatagcttggaatattcacaaaaattccattatgaaaatcaggaatcacacgtaaacgctgtgcattcattgccaatttttgagcaatatttgattctttagaagtcggaataaacatcggcaatgattgaactgtttggcgatataaatgattttctcccgctaaactttgtatgaaatcaagaaagtgattattttccaccgcacttaaccagcgttgaatatgatcattttcaggctgttgggcttgatactgacagatgaatacaaccaattagatgctttgagaacgacattttgggggaattaagnatctaacaaaatcccttataaccctcataaccatccgcctgt

SEQ ID NO: 56 - DNA, 1104 bp, H. influenzae
  misc_feature (779)..(780): n = a, c, g, or t
  misc_feature (809)..(809): n = a, c, g, or t
  misc_feature (823)..(823): n = a, c, g, or t
  misc_feature (846)..(846): n = a, c, g, or t
  misc_feature (923)..(923): n = a, c, g, or t
  misc_feature (945)..(945): n = a, c, g, or t
  misc_feature (951)..(951): n = a, c, g, or t
ctgtatacgatatcgactcggtacccaggaagtgcctttttgttgttcaactaattgagctagaacagtcgcatcaataccaggaaccggaatgaatgaaccaattcgataaacgataagtgcacctaaaacgaaaagtaatcggctttttaattcacctttaccgctattagtacttcttgcttgataacctggttgtttagccatttgctaattattcctcaattgaaccgccagcagcttcaattgctgcttttgcacctttagttacacgtaaaccgcgtaccgttactgcagatttcacttctccagctaaaattactttagcgaattggatatctttagttaagatatttgctgcttttaatgtttctaaagttactacattaccttcaactttggttaattcatttaaacgaacttctgcagtcactgcagatttcattgaagtaaaaccaaattttggtaaacgacggtataacggcatttgaccaccttcgaaaccgcgacgaacaccgctaccagtacgagatttttgacctttatgaccgcggccaccagtcttgcctaaacctgaaccaataccacgaccgaggcgtttagcactatgctttgcaccttcagccggagatagagtatttaaacgcatctcttactcctccactttaaccatgtatgaaacttggttaatcataccacgtactgcaggcgtatcaattaactcaacagtgtggtgcatatggcgaagaccaagaccacgcaaggtagctttatgcttnncgtaacgagcaattgagctacgaacttgngttactttaatagntttagccattattcattaccccncagatttcatcaacagtttacccgcgttttgcagcaaccatttctggggatttcatatttgctaatgcatccatagntgcacgaaccacgttaatcggngttggntagacccatacgctttaaaagggaacgttacgtacacctggcactttcaataccgacgcattgcacaacagcggagatacctggccttcacttgctggctgataaaacacgcgaacagattgaccccttaaatggaggggaagggacctcatt

SEQ ID NO: 57 - DNA, 1075 bp, H. influenzae
aggcctccggttactccatgtaacttgaatgataggcactggtattaaactcggttttatgaagtatattgtgatcataatgtgtgtcaagtgcgtctgaacatagaattatctccactgagtagacaaacatggtaaagtccactgatattaccttgacctttttggctaaaaataccttcaaaattgaccgctctttttcccgcattaaaagctttttctccctctttgatcattgtggtgtaatagtgatcgctaccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacccagcgatgctaaaatcgatggatcccaattaccgctagtaaggttctgtattattgatgctccttgcattgcgcgattctgcaggaattgattcatttcttcctccccgccctttttccatcccttcccttctatgcattttctggaccacctttcccccgtttgccctttttttccggccccccctttttctcgctgctttccttagccttgtgcgatgtttccttttttcttttttccgtcgtccccctgtttgttctccctttttcccctttttgtcccgtcctccgttttcccccgccccgccgtccctttcctttttacattctccccccctttttgccccccgttatatctttggccgttagttgccgccgcccccgtttttctcctttttcccccccgcctcttttcccccccctttttcccccgccctccttgtccttgttctccgtccc

SEQ ID NO: 58 - DNA, 962 bp, H. influenzae
tgtttacgattcggactcggtaccctttctccaactgatttcaagttgattttgacatctttaattgttaaatattcccacaccaaattgagaatattttgatacgttttggtttcaacgctaagctcgttcatttgacagaacaatttaaaatttggtgccatacgttcacataaagcagccataaaagtaagatgttgccaactgtctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcatgaatttcactttcctgcaatgttatttctccgctttcataatcagccagaaaaccgaccatttgagaatttggaaatgcccaaggttggctaccgaaataacgaagattttttattgaaatccctgtttcttcaaaaacctctctctgcaccgcttgttcaaatgtttcccctacttcgacaaaacctgcaagcgtcgtgtatattcctccgttaggactataatgtcgcttatgatttgccaatagattttcgtgaccacgacgaaccgcaacaatatttgatgggcaaatcacaggataagtttgatacccccagtgattacattgcactgcaagtcatcttgagtttggtggggtttatgaccggacttccacaaaattattggggttttacgaaaggataatttcccaacctcggtttatatatggaattcatcctctggcggggaaaccaggttcccaactcccaatttcggtgataaatttttgttaacccagccacaagggtgatttgtctttctcatttgcatgcccgtgcccttcaatcgatttttacaac

SEQ ID NO: 59 - DNA, 919 bp, H. influenzae
  misc_feature (623)..(623): n = a, c, g, or t
cgatatcggctcggtacccagtggaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcggttggtttaattgcattaattaatgggtattttaagtggcgtaggcgggatgggttcggctatggcgacttaaccttacatctatctttggntttaattttaaaccattagcatacttaattcggtgtaactgatggtgctgaagcaggtattgcaggacaaatgatcgggatgaaattacgggtatggatttggggggtatcttggaattgcaaaaatttacaccagatctgcattgtataactgaaaaacaagcgatatacttcgccttttggggtttgctacttcactcatgcatctaattggggggttgagggggatgccccaaccgccaaggatgtggtccttaaggtacaagccgctatggctgaacttcgctactaatgag

SEQ ID NO: 60 - DNA, 885 bp, H. influenzae
aacttgtttaaagcgggtgctaaagggtacatatgtgttcctgtcagacaattattggcaaaaggcggtattcttaatttttccgttgaatatggagaatcaacaaaaacgggttgatgcagccaaatatcgcaaaaaattagagtggtgttgatggcaggttttactgcgggtaatgaaaaaggcgagttggtattgctcggtcgtaatggctcagactattctgccgcctgttttagccgcttgtttaggcgcaagtgtatgcgaatttggcccgatgtgggcggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgttcttctcggcattagcgcaggcaaacattagcattgtggcgattg

SEQ ID NO: 61 - DNA, 1239 bp, H. influenzae
gtaattcgactcggtaccctttgtgagttgtgtctaataaatcgctaaaaaaatgctaaaagtgatgatatgagaggggggaatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactttaatctataattcaatataaaaaataaccgcacttcaatctgcttctgaattagttaaagaaaatagggtaccgagccgatattcgt

SEQ ID NO: 62 - DNA, 902 bp, H. influenzae
  misc_feature (537)..(537): n = a, c, g, or t
attactcaaagcaaacagatttgtttatcttaaataaaaggtggaaaatcttatggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtatacttcaacgcatacgcaggtcaagatatcgtttctaacgcatcttggacaacagactgtttagctcctttagcacgtgttgntcatgagactttcggtatgaaagatgggttaatgaccactgttcacgctgcgactgcaactgttataattgcggatggttccatcatcctaaagactggcgtggatgctcgccttgtttttccaagacatcatttaatttttaccaggtgcaggtgaagccccttggtccttttcttccttgttttaatcgtgctatgattcgggttggttccccccgctccaccgccaatcctatttgcactcctcttatcttttttcccctgccttctcttttctctattctctctccaccccccttcactccttccttaccccctccccctgcgttcttctatgcgcttctcgcctcctcccttgtcctctt

SEQ ID NO: 63 - DNA, 836 bp, H. influenzae
  misc_feature (257)..(257): n = a, c, g, or t
tccattttggcgtccggcaagttccctttttaattcacaagccatagctgattctcaaactcgtggtggtaataatactcttgaaaacaatgtgttccgtttgaaaattgatacattgggtggcgatgtaattagctctgaaatattaaaatatgatgcagaattggattcaaaaaacacccgtttgaattattaaaagatactaaagagcatatttatattgcgcaaagtggtttaattggtaaaaacggtattgnatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaata

SEQ ID NO: 64 - DNA, 1007 bp, H. influenzae
cttggttgctttccattgttttagaagaaatactttagtatccaccccacccattgtgacttcagctgtacgatagccctctgtgccatttggagtaaattcccagtgatgaataaaatccaccagattttttacccgcactttgctgatgttagcgctaacttcatcttgcacaatgccttgttcaatccaaagttcgaccaattttttcggcaataatcgaaccaagatggttttcaacatttgttttggtgaatgttgttttgcttgattaatttcctcttccacattgtggttcggtaataaatcgatttccactgactcagtgggctgccaataattagaaatttgtaacaccgcagggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagatatgagctggcgtacctctaaatggtgaaatacaaaaccaccgcccgacataaatcttacgtccgattttttgccgttgtcgaaactgttaccgatgcctagcttacca

SEQ ID NO: 65 - DNA, 858 bp, H. influenzae
atatggaatttaacaatgatggtctccaattattcaaacaaaatcaaccgcactttgtaggcaatcgcttattagtgaatggtattgaagcaccatatttagatgttgcacggggttggattcgtttacgtttgctcaatgcctcattagcgcgtgcttatgatttacgcttggataatgatcaagaaatgctacttattgcacaagatttaagtttcttacccaaagcgaaatcagtcaaatctttggttctctcgccaggagaacgcgcagaaatactggttaatatgaatgaaattgacaacgtatctctcattagcggaagtaaacgtagcttgtacgaaaaaataaaaaatatgttgttctcaggcgatgaactcgctaataacaccgtccttgaattacgtgctcaaggacaactatccgcatttaacaaacaaccgaatctaactttcgaaacggatgcaccagcaatattacaacaagccgttgcacaaactcgagaatttaatattgatgtcacaaacggtttaattaatcaaagacgttttgacccgcgcaaggttgatgttatggctcgtaaaggcaccattgaacgctggattttaaatgcaagtttacctgttggatttactattcaaggtgccaaatttgttggtggaaagccaaggagaacatcaattacaagctgaagaattagcttggaaagataccgtttgggtaaaaaacaaactcaaattttatgaaatttgatcaagcattctctggcacttcccttcttatttggggatcgaatttatgttagaagattgggctgtttggcgtatgatggttcatgacaaaatttatcttacccag

SEQ ID NO: 66 - DNA, 1141 bp, H. influenzae
  misc_feature (822)..(822): n = a, c, g, or t
  misc_feature (904)..(904): n = a, c, g, or t
  misc_feature (928)..(928): n = a, c, g, or t
  misc_feature (972)..(972): n = a, c, g, or t
  misc_feature (1024)..(1024): n = a, c, g, or t
  misc_feature (1067)..(1068): n = a, c, g, or t
  misc_feature (1070)..(1070): n = a, c, g, or t
caaaattgtaagaaaggtgaatacagtggtgctgatgtatcgcgtgaaggtgtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctttaaagataaaaattttacatataaaagtgcggtaaatttttaccgcacttttttgttttctaaattgagaaactaattagtttttaatttactccaatatttttcataaatatcaacagcttctcctacatcgccttgcataattcctttttctacttcttccgctggtggaaataatttggatcattagcaacttccgcgcttagcaatgttttcgccccattatttggcatagaaaagcccatgcgttcgataacaatttttgcattntcagggcgaagtaaaagtcgatgaactatacgcccttccacgttttgagcggaattcggatagcatattatccatccagaanattgcgccttcttttggatcacanattgagagaattgatttccttctgcgctaaatagctgaacattncaaatatccaattgcacttcgcttgtacggaaaggacttcagagaatagagntaaagtcgctcattgggaaccgttttctaacgctatagctggnntngatgctcttaattgggggaattggcgattaccatcaagataagctacgggacacttacgccatactggaat

SEQ ID NO: 67 - DNA, 1041 bp, H. influenzae
  misc_feature (829)..(829): n = a, c, g, or t
  misc_feature (945)..(945): n = a, c, g, or t
ggtatacgaattcggactcggtacccagctattctccaccaacagaaatatcaataagaaataagcaaatttccctttttttaataaaaaattctatggattataacaaattaatctaaggcatttttcgtaaatgatcgccatcatttttgtgtaatttcataagcgaccaaacaagggcgattacaaaaagtgatgaagttaaaaaagtatagctgaatgcctgttgtaagcaatcacttgcgttaaagaaatgtcgataaagatttaagattattgatgacacagcaataccaaatccaatcccaacttgctgtacaatacttaatacggtagagcctgtgccagactgttgttttgaaagatcgcctacagccagcgtattaattgaagtaaaaatgatcgacatacaagccccataccacataagattacaaataatccaagttagagagctttgtttatctaaccaagccattgaaatcacagaacctgccatcaaaagtgcggatgaaattaacgtggttttataaccccaacgatttaaaattcgtccaattaatattttcaacatcacagaaattaacgcaatcggtgctaatagccagccagacatttcagcactgtaaccgaaagataattggaacatcaaaggcaataaaaagggcacaccagatgcagataatcggataaaaatattagcaataatacctaatctgaatgtacgagttcggaaaagggataaaggtaaaatggcattttcattgtttttagcatagccacaataagttacgagtaacagaataccaacaactaatatgctataagntacacttgaattatgctgactttctccgagtaaatccaaaccaaagcgtataccaactaaccccatgcaaagagtaaaaacctgtccatctaattctctgcctgcccttgatatgntcacacgctgccgatgcaaaattctagccaccatgggatatttataaaaaatcatgcaactgcgtgatgactacatcactaatagccctagatgcc

SEQ ID NO: 68 - DNA, 978 bp, H. influenzae
ctgtatacgatatcgactcggtacccggcctgttttgctatgtaatcaacgacaaattgttgatcgccactcataattacgacatcaatattttgctgttgtaagcgttgaatggcgtgcaagctatcgttttttaaagtatccgtcagtgcatatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacattttttgttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatatagtgagtgcgaaagtacaagtgaatcactaaaacgacaggaacaaacacggaagcaactttgtcagcaatcgagcaatgggtgcttttgaaccttgtgcatctgatatgcatcatcatatcgccagtaaggtttgctccaagctgatttgcttgatagatatagaacttctgtacatcgcccccgctatacttttcactctttgttttctctgacgagatcgcccgtaaggctgcatcaccatccattcccttcatatgcggttgcgag

SEQ ID NO: 69 - DNA, 1297 bp, H. influenzae
atatcgccatcacggttttactgaacaagatctcaacgaaactttcaatataaatcattacgtttataaacgcgataccattaaacttggcgaattagctcaaatgttgaaagaaacatattgtggctcaattggcttggagtttatgcacgtgcaggatatggagcagaaaatgtggctccagagcaagatggaaagcctgttagataaaccgctttttacatctgaagaacgtgtcaattttcttcgtgaactgacagctgcagacggtttagaacgttatcttggtgcgaaattccctggggcgaaacgcttttctttagaaggaagtgatgcgtttattccattgatgaaagaaattattcgccattctagtcgtcaaggggtaaatgatgtggtaatgggaatggcacaccgtgggcgtttgaatatgctcgtgaatgtattaggtaaaaagcctgaaaatttattcgatgaatttgcaggtaaacattccagcgaacgtacgggggatgtgaaatatcatcaaggtttttcttctgattttgccgtagatgataagagagtccacttaacgttggcatttaatccatctcatttggaaatcgtaagccctgttgtgattggttctgttcgatctcgacaaactcgtatgaatgatacagaacatagcaaagtgcttgctattactgttcacggagattcagctgtggcaggacagggggttgttcaagaaacattgaatatgtcaaatgcccgtggttacagtgtgggcggtactattcgcatcgtgattaataaccaaattggttttacgacatctaatccgaatgacacgcgctctacagaatattgcaccgatattgcgaaaatgattcaagcaccgattattcatgttaatggcgatgatcctgaagcggtggcatttactgcgcgtatggcggtggaatatcgtaatttattcaaacgagatatttttattgatttaatttcttatcgtcgccatggccataacgaggcagatgaaccattagccactcaaccaatgatgtatagcatcatcaaaaaacatcctacaccgcgtaaagtttatgcagatcgcttagttttcagaggcgtgatgactgaagacaagtacccggatggcgaatgattatcgcgatgcgctagataatggcgatcgcgtggtatctgaatggcgagaaatggatcggccaaaatgggttgggttgcatatcccattttgatgggcctgcccgccgaaagccatattcccagacccgtttttacgctggta

SEQ ID NO: 70 - DNA, 883 bp, H. influenzae
atcccctgcggttttttattgcatccaattttagtactaaagtaacaacatacgatccccatttgataatatcaaagaataatttattttgattggttgcaatgccatcaaaattttttggtgtgccatcttcatttttttgcacttccaccataccatttttatattgacctttcacgacagccaaatcatcgtgcgcttcgttacgcaacttcaaacaagactgtttagctaaaggttcaacattgctcactttggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcggaaagttggtaatcagccccagcaaattccgctggaattgcggattgttgactatcaaacattgaacagccagacagcaatgctgccatacctaaggttgcaattaatttcacatttgatccttataaaagtgagaatgcacaaaattctagcaatatcttcacaacagataaagcagcaaatgaatttagttttcctgatctgaaaaacttccgctataacgaccgcacttttttacgtttaattaaaggaattcttatgcaaaatccaaaagatgatgtgttatatgcgcctgtttaattgttcgattcccgggaatgttttatcgatatctctttttttaaacctctgttggcttgctaaattaccattaaccccttatttcgcttggt

SEQ ID NO: 71 - DNA, 875 bp, H. influenzae
gttatacgaatatcggactcggtacccaaaaagtatagtgaaaagcagaaaatgccctaattgcggcttctctttcaaacaaaaagatctagagatgtacaaacaaagattagaagctcgacgcttacataatgaagaagtcaatcgtaaaagcacaaaactccacataatttggttttgcatctttgctatttttatcgcagtcacaagctggatggtaaattaatctatcaatgataaatttattaaggagttactattaactcaaaaagctgataaaaattataattctatttataacttacaatggcttgatgaaaatacatcgaaaaaaagatgcttctcttgaagaatggtagataaaaatgcaaaatctaatataacctcttttttcgacaaccatctttatacctgatgtgaacttatctattggtaattttgatcaattctttgaggaaagaaaaattatcttaattaagaaattaagtgatttattaagctaatttataatcatatatcaaatggtagtcattctggaatgtataaaatcttaagagaactaccacttttatctgattatcgcaagttaaaattctaactactaatttagtataaattaaaaatataatttatctttattaaaatatttttataataaatttcatctattttggtatgaaaatgtattacttaataatatttctggaaccattatctattgccgctaggagtaaattaacaaaaataccccgcatttttaccgcacttttatatcttcataaataaaaaatctgccctcaaatagctaaatatttcctttactaaatcagagcagattgaatgcggtattttttatttgaatatacattaagtta

SEQ ID NO: 72 - DNA, 913 bp, H. influenzae
atggtatacgaatatcggactcggtacccacttggtatggcatcaccaaatcgagtcattctctcttttgtattaattgcggtattgatttccgtgatgttatttaatgaaaagtgatgttaaaaatcacagaatggcttgtttatccgttagtcttaattttatttgttctttctatttacttaattcctgaatggaatagtgccgtattatatgaatttccaacaacaggtggtttcttaaccactttatggctaaccattcccgtattagtattttcatttaaccattcgccagcgacttcatcgttcacttgctcacaattccgtgaatacaaaacgtttgagggtgcagaacgccatatcagccatacagaaaaaggcgcttcaacgattttattattcttcgtaatgttcttcgtatttagctgtgtattaacactaacacctgaagaattagtggcagcaaaagaacagaatattagtatcttgtctttcttagcaaataaatttgataatccatatatctcttattttggcccgcttgttgcattcttagcgattacaagttcattcttcggtcactatatgggggcacgtgaaggattagaaggcttatatttgaaaatgaaaggcgaatctgtaaatcgtaaaaaactcaattatgcgaccgcacttttcttcttattaaccttatggggcgttgcgattattaatccaagtatcttaggcttaattgaatctcttggcgccccatcattgcgatgattttattcattatgcccatgtatgcgattcgcaaaatcccagcatgaaacgctacagcggcgtttcagtaatgtatttgtacaattatgggactacatgctatttttgcaggttgttatgggatatttataaccgctttaaatatt

SEQ ID NO: 73 - DNA, 591 bp, H. influenzae
  misc_feature (134)..(134): n = a, c, g, or t
tgctctatcaataaatcagaatatttgataattcccacgctcactggtacaaaaagtaccgccataaaacgaattagcaaacttgcgcctaaataaatccaatttaaatgaatcactcgtgttgttaaacctanaaagagcaataacaatccccaaatacttcctggaacacctgatggaatgtaataagcaataagatttccgagatataacataatagataaaatgaccaacgaacgaactaataaaaataatttttgaatcatatacaaccttttcaactattttcataatatttcaaaattattttacgcttttttttgctaacttgagccattttttcggtaaaataaccagacttagatcaaaaactttgcaaaatgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagccttgggcaaaaatcgaaaaa

SEQ ID NO: 74 - DNA, 898 bp, H. influenzae
tgttatcgaattcggactcggtacccggtagattttccttctccatttgcattgcctgtaatccttccaaatcgatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctacgccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtacccggataacgacgaaatacgaatattcgttccttttcctgggggctaaaagtttccgaaaagcgtttggcggctcacaattaggtctgctgggcgccggttctaaacacgttttaaacccgccagaacgctttgtatcaacgcctttttgccttttctcccgccttttcttc

SEQ ID NO: 75 - DNA, 1510 bp, H. influenzae
  misc_feature (1424)..(1424): n = a, c, g, or t
cgcgtaatgggagatggttggacagtaaaaaccaaagatcgcagccattcagcacaatacgaacatcaacttgttgtcacggaaactggttgtgaagtaatgactatccgcgatgaagaaattgcagaaggtcgaatttcgcggattatggtgaatgtgtaattgacataaaattataagataagggcgtagatatacgccctttttgtttttctttataataaaacgacttcgatctaacaaaaggcaattcatatgctgttttctccgacactatcttctcctttaacgccaagtgcggtcaaaattgaacgagaaaatctcaagcaatttgagctcgagaatttttctcgttattccatttttgagcttattgaaaatcgctgtgatttttatgatgccttattgattcaactttggcaggaaatagaattaagtgaacaactggggattgctttaattgcggtgggcggttatggacggcgtgagatgtttcctttgtcggatttagattttttgattttagtcgagcaaaccccaagccctgagattgaagaaaagattactcaatttatccagtttttatgggattgcggttttgaggtgggaaatagtgttcgaaccttagaacaatgcgaatcggaagggaaacaagatattacgattgccaccaatttattagaagcaagatttcttgctggaaatcgaccgcactttgatgcattaaatgaattggtaaaacgtgcagatttttggtcgaaagaagatttttttaatgccaaagtgcaagagcaaatagaacgttatcagcgttatcacaatacggcttataaccttgagccagatattaagtacagccctggaggcttgcgtgatttgcatttgttgtattgggtggcgttgcgccattctggggctttgacccttgaggctattttacaaagtggttttatttatcctcaagaatatcagcaactacaagaaagtcgtgcatttttatttaaagtgcggttcgctttgcatttgattttgaaacgttacgataatcgtctgttgtttgatcgtcaaattaaagtcagtgaattattgggtttccgaggggaaggcaatccagctgtggaaaaaatgatgaaatgttctttccaagcattgcaccgaatttcgctgattagtaatttactgattcagcattatcgagaaaatgtgctttcatcaaatcaggatactgtaattgaccaattagacgatgattcccaactgattaaccaatgcccatgtttcgcgtaatattttttgtttttcatggaaaaaccagcgcgacgtttagattctatctttttatttaacccccgtacgaacctggccaataattatttctgagtctttgggcgcgattacctaattcccttgcaccaactataccnaatttattccaaacccctgcccgtttgcgaaaattttctccgctctttttcgaccccatgtcctttattcgggcgctcaccgcttg

SEQ ID NO: 76 - DNA, 1342 bp, H. influenzae
  misc_feature (1304)..(1304): n = a, c, g, or t
ctttatcacttatattattttcttaattttcgggctaaattatccactcttattggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagattaaataatctttgaattttaagtactttatttaattagagatttatataaataaaaaatagttaatcgtaaattttcgattaactatttttttaatttattctaaaagtaaatcaactaaggtaattcatcaatttctttatctactttaggtgggatcatatgttcacgacgtaaaccaacatcgtatgcaatggcgatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaactcggtcaaataccacaatactatcgttgatggagtaacccaccacagataaaatcgctgcgacaaaagtaagatcaatttcaatttgtaatgcagagaatacccctagcgtaataattacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgaacaactggactttcaattccattttcgtgaagtttactacgaatttgttcaaggttagcggactgcgagaagtgagtatcaaataccactccaccagtaaaatctaagccccagttaaatnctttggtaataataaaaaatagagaaattaccataaaa

SEQ ID NO: 77 - DNA, 1257 bp, H. influenzae
tattcgccgtacggttctgtaaaagaggcgaaatattattggaaatgaaactcgcgtaaaagtagtggaaaaacaaattagcggcaccgttccgccaagtggatttccaaattctctatggagaaggcatttcaaaagcaggagaattattagaacttggtgtaaaacacaaacttgtagaaaaatcaggcgcatggtattcctataatggcgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaataaagaaaattacaaatgccaaaagtgcggttaaaaatgaccgcactttatatcgattcaataaaatgaaggaataaatccttgtcatctcttgcttttaattacatagttaatcttctttcccgcagagaatatagtgaattcgagctccgcaataaaatgcaggaaaagaacttttcggaagaagaaattgatgatgcattatctttatgccaagcaaaaaattggcaaagcgatcgtcgtttttcagaaaattatctaaattcacgctcacaaaaaggttgtggtgtaggaagaattcgacaagaattacgccaattaaaaggtgtgtcttctgatattattgatgaagttttaatggaatcagaaattgattggtatgaaatggctgagaacttgttacgtaaaaaattcccaaattataacgaacagcaaacgtctaaaatgaaacaaaaaatttggcaatatatgctatcacacggatttcgtagcgatgaatttgctgatttaattgggcaaaaccaaagtgaatgggattaagataaaagttgagaacaaattttatatatccaaatgcctaacacagtcatagctaaacatccgaataaatgcatcattaatacacaaaatccatttaaccacttgtcattaaaaaataattccacaacttcggaagaaaaagacgaaaatgtggttagcgatcctaaaaaacccgtaattaaaaataaccgccattcagaactaatttgtggaaattgccaaaaaaacccaagtaatacaccaataattaaacaaccaagcaaattagcgattaaagtcccaaaagcaaagaggaaaaaaagattaataagggaccgagccgaatcgaaca

SEQ ID NO: 78 - DNA, 994 bp, H. influenzae
  misc_feature (960)..(960): n = a, c, g, or t
gcctgcttgctgcctgcggtcgactctatgagaccccgtcatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactctcacatattcaacaggaattacttagttcggtaaaagatattgttctcggtaaaaataaaatttacaaaaaggagcaaatctgatggaaatcgaggttgtttatcaacatagcgattttattattatcaacaagtctgagggtattagcgttcataaagatcaagaagagcaaggcttaacagaacttgttgcaaaacaactgaatgtgcctaaagtatggttggttcatcgcttagataaagtaacttcaggtttgttaattctggcgttaaatgctgaaagtgcggctgaattttcacgacttttttctgaacataaaatacataaaacgtatctggcattaagtaaccaaaagcctaaaaagaaacaaggtttgattatcggggatatgaagaaatcccgagagggtgcatggaaactttgtcaaaccaaagaaaatccagcaattacacgttttgcaagtgtaagctgtgaacctaatttacgtttatttattttaaaaccacaaacggggaaaacgcatcaattacgtgttgcgatgaaaagtttaggtagcccgattttaggcgatgggctttatggtaaaaacacagaaaaaattgaccgcacttatttgcacgctactcaattggaatttgattatctaaatgattttatttcggtcacttgtttacctctcaaggtcaattttggattaagcctacagttttgagcaggggatttcntagagtcgacctgcagggcatgccaagtctgggc

SEQ ID NO: 79 - DNA, 725 bp, H. influenzae
  misc_feature (694)..(694): n = a, c, g, or t
ttccactccatttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaataattttccgatttgaaatggaaaaagtgcggttgaaatttcctaagaattttcaaccgcacttaataaatattgattgtccattaatggtgttgtgattactctgcttgagtttccacgttttcaactgcttctgttggagtggtatgatggttattattgtgatgcgaaactgaacgagcaggcacggggtnctatagagtcgaccgcaggcagcaagctggc

SEQ ID NO: 80 - DNA, 1315 bp, H. influenzae
agaaggatccccacttaatgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttattgaatttgccggaaattttgaagagccacgaaacacggaagaagccccagtttcagccagtgaagatgacccggagaacggcgctttggtattgacacagctttaaccctttctcccaactgaggaccgctgatcgtataatgagccttctcccca

SEQ ID NO: 81 - DNA, 1365 bp, H. influenzae
  misc_feature (1309)..(1309): n = a, c, g, or t
tgtttacgaatatcggctcggttccccgattttctcttcaattggtttagctcagtattagttcagcctaatatcaatcataaaagtaaaacggtagatatagaaatcattctttatccacgtaaaaaaaatgcgatggaactcggtgtgggctttgctactgatggcggcgttcacggacaaataggctggacaaaaccttggattaatagccgtggacatagtttgcgttcaaatctttatctctctgcaccaaaacaaactctagaggcaacttatcgaatgccactgcttaaaaatccattaaattattactatgattttgccgtcggttgggaaggggaaaaagagaacgataccaatacgagagtgcttacgttgtcagcgttacgttattggaataatgcgcatggttggcaatattttggcggacttcgtacgcgatacgacagttttacacaagcggatatcactgataaaaccttacttctttatccaactgttggatttactcgtactcgattacgtggtggttcctttgccacttggggcgatgtgcaaaaaattacttttgatttaagcaaacgaatttggctatcagaatcttcttttataaaagtgcaagcatctagcgcgtgggttcgtacttatgcagaaaatcatcgtatcgttgctcgtgctgaaatcgggtatttacatacaaaaggtattgaaaaaattccgcctacactgcgtttctttgctggtggcgatcgtagtgtgcgcggttacggctataaaaaaattgcgcctaaaaataaaaacggaaaattagttggtggttcgcgattgcttaccgcttctttagaatatcaatatcaagtctatccaaattggtgggcggcaacttttgcagatagtggattagctgccgataattacacggcaaaagaattgcgttatggtgcaggcgttggtgtgcgttgggcatcgccagttggtgcgattaaatttgatattgccacacccattcgtgataaagataacagcaaaaatattcaattttacattggacttggtacagaaatttaaggggaatttatgacagaacacttaccaccatcagaaacttcaccaaaattacctgagaaccctaaaaacaacattgggtacccttggctgcccgtatccgcaatggccgcccatttttctgcccgctgtacggtggacaccgggccgccctcattttcgtcgcgccgcgaacttgttttgctcccctctcccgacgcaccccaaggactttctgctcgtccctcccgcgtgcctcctncacgcccttcgcccccttgtgcctcacctatccgcgcgcggccgtggccgttgcgc

SEQ ID NO: 82 - DNA, 1405 bp, H. influenzae
  misc_feature (1087)..(1087): n = a, c, g, or t
gatggtcggcttttccatggtactattaagcgaatgtgaatccaagccattggttttcccttatttcataaaatggggcgtattatcccgattttttcaaaagttccggtagtaacatcaagccaagggtggctaccataataattgttatgccaagtacggctgaaaatgacagcgtttcgccaagtaatgatacggcaaataagattccgaataatggttcaagtgcaagtaaaataccagagatattagcatcaacggtattgagtcctttatgccataaccaataagcaagccagctacaaccaagcgcaagatataataaacctacaattcccgtggaatttaatgatatttgccagttttctgtcagtaataaggtaaaaggtaatgttgttataacaccaagaacaatactgatggatgtgtaaacttgcgttgaaactttggcaacaactcgccgcgtccaacgtaatacagtcgcaaaaataatccctgcgcttagcactaataagcaacctaataaactaacattatcaatgccttcattattttttccaccattgattaaaattgcaacgccaataaatgccattgcgccgaatagccagtgaaaccattttgctttgtctttaaaaaagaaatgtccaacaaatataacaagtagcggttctagcccaatcatcgtaacggcactagacgcagaggtgtatttcagaccaataaattgtaataaaaagaccgcggtatagttaaagaatgccaaccaccaaagttgtttacgcattggtttatcgatttttttccaacgacgcaaaaaaagtggcattaccaaaatcattgcaataattaaccgcacttgcacaacaagcacaggatccatcatcgaataagtgagcttaccgacgattaatgaactgctccaaataagtagcgcgagaatttgatagagcattgatgtatccctgtgaatagttccaattctatgttttagcctagaaattgctgaaagtgagaaaattaaatatcaccttcctctaagtttagaagaaggtgacagcatattgattgacgcttaaagcgcggnagctcttaattgagttttttcgactcgacgttcgcccacattattacctactaaaacagtgatctatcctttatgtcaccgacggttctatttgatgttccccttattattctgctgcctagctgaccgcagcactatatatttttccactttcgcattccctttcccatccccccttacccttcgttttattccttcccccccttttcattttcccctctcccccgttcttcccccccctcccccccatttgttttttttacctccctattcccccgtccttttttcttgttcccccccccctttatcctccccccc

SEQ ID NO: 83 - DNA, 1431 bp, H. influenzae
  misc_feature (1229)..(1229): n = a, c, g, or t
  misc_feature (1258)..(1258): n = a, c, g, or t
  misc_feature (1263)..(1263): n = a, c, g, or t
  misc_feature (1292)..(1292): n = a, c, g, or t
  misc_feature (1411)..(1411): n = a, c, g, or t
gttttcttatatcagcctcggttctcgtatctcgggtatttcgtgtgtggtattggtaagtaaaggtaaaattagtaattatttctttggattgatttttgcctatacttatttttatgttgcttggggatcgaatttcttaggcgaaatgaacaccgtactttacgtatatttgccctctcaatttattggttactttatgtggaaagccaatatgcaaaatagcgatggtggagaaagcgtgattgcaaaagcattaactgttaaaggatggatgacattaattgttatgactacggttggcactttgctttttgttcaagcattacaagctgctggtggtagttcaacaggtttagatggtctaactacaattattacggttgcggcacagattttaatgattttacgttatcgtgaacagtggttgttatggattggattaaatattctttctattttcttatgggcagagacacctgcaatatacttaatgtattcagcctacttacttaactcgttgtatggttattataactggacgaaattagttaagcgtactaactaaatataaaaacagtaaatagcttataaaaaatccccgttaaatgataaatttaacggggatttttttacttcaaaaacatcaagttatatcataaccaaataaaaatatttcatttttttaccgcacttattgcagaaccaagaattacttcacagattttttgtgattttcataggctgcttttacaaagcctgcaaacaacggatgaccatcacgaggcgtagaagtaaattctggatggaattgacaagcgacaaaccaaggatgatttggcacttcgataatttctaccaattttttatctgcagataatccagttactttcaatcctgctttttcaatttgtggaagcaaggtattgttcacttcatagcgatgacgatgacgttcttcaatgggtttctttgccataaagctcacgagcgtggctacctgataccaaatgacattggttgtgcgcctaaacgcattgttccgccaagatctgattcatcggtacgcacttcagtattaccctccgcatcttgccattctgtgattaatgccaccacaggttgttcacaatctttatcaaattcagatgaattggctttagttaaacccgctacattacgtgcatattcatcaaatgcgatctgcatacctaagcaatacccagtanagggaatttttgttttctcggcatatggngcggnaccgaatttacctctacacacgataccanatccctggaacagatgcatcacgcctttatactcaaccctttggttcacatctggatcatatattatgctacttaaccggtgtaacccgcggtttaagctcattctgatatagctcggnacctaaggatactactccga

SEQ ID NO: 84 - DNA, 1440 bp, H. influenzae
  misc_feature (1360)..(1360): n = a, c, g, or t
tggtatacgaatatcggactcggtacccctttttttatttcttgtgtaacacaatcgcacattcaatcgaatgttgcgtcgctgccaaatgtttactcaatgcttgacgtattttgtcttcttctttcgaagtgatttcgccgtcttctaacgctgtttctaatgcagcaaataacaagcctcgtgcggaaagctcgtgcagttgtaaattagcaagctcaaccttgtctaattcattctctgctacatcaggtacaaaacgcccaccagccaaacggcatagttcatcaataaattgcgtgcagccatattcttgctgaatcgcaattaattcttcatttttgaatcgctgaccctttgtttgataaagacgattctttaattcactttcggtaaaacctaggaatccagctaccgcacttctccccccaggaatccgatcaaccatttcgataataactttcttcatttccataatttttgccttatttttatggttttctttttggtaaaggttggtaaattaatcccacaaatcaggacgtaattcggatttcttgacttttccatctgtaagttcttcaatctttgcgcaacgttccgcaggtactttttcacgccacttggaaacagcccaaggggtaagattgaaatgtcgagccatagccgaaataccgcccacgatttcataagctttttcgattggtagcattttaacctctttattctatttaaagtagtataattctactattaaaaatagaattgaatcaaccattttaattttgtatcttctacctttagtagaataaaggagtgtctatgacagatttagcaagccgacttaatgaattaatggctaaacaaggcaaaaatattgtggatttacaaaaagctgttggcgtaacctatgaaatggctagacgttacactttaggcactgcaaccccgagagataataaaattgaagctatagcgaagtactttggagttacccctgctcatttgaaatacggaacagtcgattctttagaaaatcaagtaacttctaatgtgaaagacgttggctcattcgacttatgggatcgcaatactccactaaatagcgatgaatacgccgttccgttttatcaagacattcgccttgctgctggaaacggatttgctgatgacatagcggactataacaacttcaaattgcgtttttccaaatcaacactacgtaaacaagggcgtacagtacgaaaatgcggtatgtgtgatttgctgacggaaactcgatggagcctgttattcccgatggaacacagttggcattgatcttgggtataaacaatcgagagggaaatatcgcataatnacgggggctctacgctaagctcttacatatgcaacgacaggaaaatcgagttacacgagacccctgtgaatacgatcgaa

SEQ ID NO: 85 - DNA, 1478 bp, H. influenzae
  misc_feature (1254)..(1254): n = a, c, g, or t
caggtgaagttgaaggcgtacactattattttgtatcaaaagaagagtttgaatcactcattgaacaagatttatttctagaatatgccaaagtttttggtggcaattattatggaacctctttacctgcgattgaagaaaatttagcaaaaggcattgatgtatttttagatattgattggcagggtgcccaacaaatccgtaaaaaagtgccttcagtaaaaagcatttttattttaccgccttcattgcctgaattagagcgtcgtttaattggtcgtgggcaagatagtgaagaggttattgccgaacgaatgtcaaaagcgataagtgaaatttcgcattatgacgaatatgattatgtcattgtgaatgatgattttgagaaaacattaaaagatttacaaagtattttgcaatcggaacgcttaactaaagattatcaacaaaaacaaaatgcaatgttaattcaacagctactagcaaaatagggcgaaattgagtattataacgccctttcaatagagcaatttttgacaaatcggagtaaattatggctcgtgttactgtgcaagatgcagtagaaaaaattggtaaccgttttgatttaattttaacggctgcacgtcgtgcaagacaattacaacttaatcaaagtgcaccattagtgccagaagataatgacaaaccaacagtaatcgcattacgtgaaatcgaaaaaggtttgattaatcaagatattatggatgcacaagaattccaaaaaatggcgaaagtgcaagaaacggaagaagcagctgttgcattaattacagaataatcttttaaaagtgcggtaaaaaatcacgatattttaactgcactttctctttcaacgataagtaggtctcctttggaactgtttgcggatttagatcgaattattcaagggtatttgcccgcagataaaattgaactcatcaagcgtgcgtttgtgattgcaagagatgcgcacgaaggacaatttcgctccagcggcgaaccttacattacccatcctgtggcggtagcctccattattgctcaacttcacttagatcacgaagcggtaatggctgcgcttttgcacgatgttattgaagaacaccttatacggaaaaccaactgatagaagaagttcggtgccagtgtagctgaaattgtggacggtgtatcaaaactcgataagttgaaatttcgtactcgccaagaagcacaagtcgagaattttcgcanaatgatttttggcgatgacgcgcgatattcggggtgggggtaatcaagcttgctgaccgcacgcatatatgcgcacgcttgggttcgttacgaccagataccgtcgccgtattgcgaaagaaacgcttgaaactattgtccgctgctctcgtttttaggtttggcccttcaaaatgaatagaagactttcttttcagcatgctccactgttttgagggttaaaa

SEQ ID NO: 86 - DNA, 1531 bp, H. influenzae
  misc_feature (1337)..(1337): n = a, c, g, or t
gagacccctcattgtggcggtggtgcggtacgccgtggtttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagattaatttctacttgattaacatcttagtattttatttaagctttcctattctaaacggcgtatcatactaaaaaattaaattgtaactatatgatatataaaaccccgttcaatttgaacggggttaaaagtgcggtaaatttttaatgtgttttatggcttgtgctatacaaaattttgtccgtataagctaaagcaattgccgacactaaaaagcccaagtgcaacaataattgccacatcatcgttttttctggcatattgcttgcattcacaaaagtttgcaacatatggatagatgaaatgccgataatagacatagaaaagtttaactttcaacacggtggcatttacgtggctcatccattcaggttgatcggggtgattacgtgtacgcaatttagatacaaagatttcatagccaccgatagtcaccatcacaagtaagttggcgatcatcacgacatcaatcaaattcaacacgcctaacataattgtgttggaatccatatcatttacattaatcactaactcccataatcctttgataaatttataagagtagattgcaagggtgacaatcaagcccaaataaatcggcacttgcaaccagcgactagcaaaaattattttcgcgataatattcgattgttcgttatatttcgcataaggatcaacaggtttgttttctttcataagattttattcctaaattaaacagtgggttaaataaacaaaaaaaccgcaagaaaatagcagtttttttgaaaatagcaataaggaaattgagttattctaattttatttgaaactgtaaatagactctcttaacaccaagtcggttctacaccaaagtgaggtaattttcattaggatttttaattcgttgcaatagtgtttcaacagcgagtttgccaagttcagcttttcggttggcaaatggtggagagaggaggcgagagataacgagccaattcaatgtcatcatagcccataattgaaagatcttgcggaatacgtaagccttgntgctgaatagcttggtatgcaccgacagcaatggtgtcactacaacaaaaaactgctgtttgacgtgaaagattggagtaagtaaagattgtttgccaagtacaccggctttaaaggcaaaatggactttcacaatccatgagggatttaacgcaatttttgttttcccacagcgcatttttataaccttgcaa

SEQ ID NO: 87 - DNA, 1315 bp, H. influenzae
  misc_feature (1270)..(1270): n = a, c, g, or t
gcccagacttggctggcctgcaggtcgactctaggaaatccccttcgtattttttgaactataccaatgccctaagtggattgcggtatttcgtgcataacgtacaattcctgcgaaggctgacagcataagccccgtgccgaaagacatggctaatacagctaaaattccccagctataaagatcaagcatataagctaaaaataaaacgaaaattgcaccgctacatgggcgcatgccaattgttagaatcacgaggaattgtgattttagattggttgcttgtgcagtttgcgtggggcttggcaaatgttggtgtccacagctacaagtgtttggctgaaaagtgcggttatttttcaccgcacttttttcgtgtagagggaggggattgagggatttaatggttaatttagcttttttacgataggcacgtagaccttgccaaatccaataacagccgagaaataccaataatagcaaggcagttcgttctaaccaaagctggcttaatttgaaataacgtgatgaaagatttagcactacaacaagcaatgttgttgctgtaatcgcgacaatgccttgcattaaggatgaaagtaagctcaagatagtgctttgttttaattggctttcatgcgtggaaagatagctggcaataataaatttgccgtgtcctggcccgagggcatggagtacgccataaataaagctgacgaaaataagtgtgatgcctgccttgatgctattattttgaatttgatgtaaattttccgaaataagctgattaaactctttttgccaactggcaatatgtaagaaaaaccaaggggaaaaatagacaagtaaggcgagtgcaatcactaataacacgagcccagttttatattttttcatttctactcacattgaattattattttttgcgcgaacattacgcctaaggaatcatcttcgttcttttgggatttatcaagtgaagatgcgtaggcttggattttttcatccacattaggttcaattaattttccttggcaatttttcgaaagtgcggaaaaatctaccgcactttttgaagcgtaagtcatcgccacataataagtgggatcgtaagtttgtaagctaaatgtgtttttttctaacttttgcggatgggcgagtggcacatcaaaatataattgcagttgtaagccttgaacattaatgccgtaattttttgggcgaaggggatattttgattttattattctgggcatcatatagatagctngaaatatgctcactgacgatatttcccattacatcatcagaagtt

SEQ ID NO: 88 - DNA, 824 bp, H. influenzae
tttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgatactcgctcacatttaatgttgatgaaagctggctacaggaaggccagacgcgaattatttttgatggcgctaactcggcgtttcatctgtggtgcaacgggcgctgggtcggttacggtcacgacagtcgtttgccgtctgaatttgacctgagcgcatttttacgcgccggagaaaaccgcctcgccgtgatagtgctgcgctgtaatgacggcatatttctggaagatcaggatatgtggcggacgatcggctatttccgtgacgcatctgttgctgcctaaaccgactacacaaatcatcgatttacatgttgccactcgttttaatgatgatcccagccgcgctgtattggaggctgaatttctcatgagcggcgagttagcgtaatactctacggtaacagttttctcatggtcgtagaaacccagtcgcccgattctccctcctttttcggtttaaacataggttagtgaaggggtagcccgattttcacctccccccgtatttcgcaattccctactggtgctccccccattccgaatctttattgtgtggcgataaaatcacccccataatgatccctttaataaccgaccccgctaattgcctttccatctgcgccgttaaaaag

SEQ ID NO: 89 - DNA, 1563 bp, H. influenzae
  misc_feature (1321)..(1321): n = a, c, g, or t
  misc_feature (1347)..(1347): n = a, c, g, or t
  misc_feature (1374)..(1374): n = a, c, g, or t
  misc_feature (1423)..(1423): n = a, c, g, or t
  misc_feature (1486)..(1486): n = a, c, g, or t
  misc_feature (1513)..(1513): n = a, c, g, or t
caagtcgttgttagacacttacaagtggcacagatcagcaacccttagatttagtgaatataatcgactatcttcaaactcaattttaatttaaaaggggaaaaacatggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctttaaaaaataatacccgcatcaaagtgcgggtattttttcaatcaaatttctgattattcaaattcatccagccattttaataaaatagcctcaagaattgattcatttgatttattcggatcgtcatcaaaatcttcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaaatcttcattaggtaaaaaaatcacttttggcataatactttcctcanaattatttaatatctgactgcagttntacggattttcaatgtctgacagattnttacctgtcaaagctttattaattgatgcattcattcggcgagcagcanattcttgggtagcagtgtctaaggctttaattccttgcgcattgcatcgcgatctgaccctgntttactccattaatggtttacacagtntcatatgatgaatcatctggctaagcattcgcccctctgttgagtgcaaa

SEQ ID NO: 90 - DNA, 1502 bp, H. influenzae
  misc_feature (1172)..(1172): n = a, c, g, or t
  misc_feature (1200)..(1201): n = a, c, g, or t
  misc_feature (1215)..(1215): n = a, c, g, or t
  misc_feature (1223)..(1223): n = a, c, g, or t
  misc_feature (1225)..(1225): n = a, c, g, or t
  misc_feature (1292)..(1292): n = a, c, g, or t
attgtcgatttccgtggcgacttcatctaaagcgatttcatagcctgcttgccaatccactttacgttggtgtgcagcatcgagttgatagtagtaatcatcggaaggtttcattgtttactccaagtgcggttaatttcggcttgcttttgtgcggtgtaagcctgcagttctttttctgctgccagtgtaagattaggcggtaaacatacaccgttttcatatatgccccctttcagttcacatcgggtttcttgttggatttgttggcttaattcgttatcgtgccaatcggtggggtgggcattggcgtgtaggctaatcccacccacaatcatggcaataatcaaggcggcgagaaaatagcagattctgtttagccatttttcactgcctttcataaagtgcgtgaagctttgtttttcttggcgtaatggggttttcgagtgtttcatttggggctccttgttagatattaagcattttttcttttgcgattttgcagctgtcttttttgatttcaaagccataggacgggcggttaagctctcgtgcggcgcgtagcgtggatgcactgccagcaactggatcaatcactacatcgccctcatcggtaaagatttcgatgaggcgttttaacacggcaatgggcttttgtgtcgggtgcagtttagggatttccttgcggttgtccttttcccattcgaaccagtttttaatcattttgccgttgttgttaaatttcggcagtttatcgcggtataaaatcaaggcatattctgttgcgccgacgactttcatattcgctttgagcacctgtggtgatgatgatttaataaacaccaaagggatgtgatttttaaagccgtgctgcttggcgtaatcaatcaccattgagatttgctggaaagcgcagaacacaatcatacaaggggctttgccgcgttctttcggttctttgatgagcatttttgaacaaaaatgcataaattcggcaatgcggaaatctttatctgtatcaaaaaaactactgttggctttgtcgctttcgccgtttttgttatcgccgtttacataccattcagggtttgaagcgtaagcattattaccgagattgtagggaatgtcggcgatgactagctgcgcttttgggatgtggtagcgtttgtagntttggaagtgattgtttaataatccggnnttcatttttggtgnttttttantngttttcacaaattccggcttttttcgtttctccttattacccacactattttcctgccgtctccctngctctctttttttctttttttttcgccctatctcaccttttttgttcgttgtgcgccgcagccttctcactcccccaccaaatcgcgtttttttttctcctcttttgctcctcccccgcccttctttttctcttctccttatcctaccccgcccttttctacttctttcttttttttccccccattcctttttcttttatttttttttat

SEQ ID NO: 91 - DNA, 1548 bp, H. influenzae
  misc_feature (509)..(509): n = a, c, g, or t
attgagaatgtgtatctcgttttgatgtggctaattctacttaaagtagatttaattgcaactaaaatttgcacaaaagtagatttattctctactttaatttgtaatccgttgatttaaaaagaaaagaattttgagaaaagttgtttgattgcctgttttttaggcaaattaggtgagggaggtgaaaagttcggtcgatttttgaggtgtttcggtgagttttaggaaaaagaaaaccgccacgaaggcggtttaggtgtcatataaatttaggagtaaagaaagtctttagtgcatctaacttataaattagtccacgcattgcagtgttccttacctcaagattatctgatacaagatgatctgtaattgcttggtttacttctcttaactccattctagggtaacgttctgaatttgataggcttttaatttccagacattttgattgcaatcttttatgaaatgcaatcataaaggtggtaatccatttcatcacttaaatntgattgtgtctttttgtggatatttaacgcttctgtaaaaacagatcgcacaaatcagataattttgagagctctccattataagctgtattttttaaaccccttgcgcctaatatatagcttataggtaacgcaaagatagaaactataagcgcggagaaagctattagatcagaaagagtcatttattatccttcaaagataaaatctcaatctctttttctacataacttttaatttcgtcaataatatcatggtcgtcatttgaaataaggtttttaacaagatttaaaacaacctctggagaaataccttttctaattgctcctccaaaagtttcttcaagaaatgaagagccatatccttctgtgtcatctaaattaagaatgatatcaggatccctttttattgctgggataagaatagaatctctaaattcctctccactagctttaccatctttaatgtaacgtggacctggatattggctgaaatcttttacataaatagtttgcattattattccttaatttcttgtagcggaatgttccactgaacaacagtaccattaatagagtatctagattctttggttaaatctggcttatctttgccattatacacatacattcctcgatttgaacgaattattagcctgcttcctggtgttttgtcaataaatgctcgaatatcacttcccccttttcctctatgtcccaatcctgttcgggtttctttaatgagggtagaggcttttatatataaacaatcttttgtcgggttccccagctgctttagtctattccaaatagtattacaggacatttgctttctgtggtttctttagggatttatggatcccggtgacccaaattcctaaacaaaaggggccaatttctcttctaaggatagcacgcaacattcccccaccagttttatagtgaaaacctccgttccttttaaatatttttgggcggacagtatgttcccacgcctttggttatttctcattggcgcttagggtaataccctttttccc

SEQ ID NO: 92 - DNA, 1248 bp, H. influenzae
attcggctcggtaccccatctgatttcaaagttttctaaacgagtaataacatctttatctacatgtttttcaaagaattgtaagtcgtctttacgctctgctaatactgcacgaaatacgtatttcaacatatcttctgcaagttttgcgttatccgctaaggttgcaaatgcaacttcaggttcaaccatccagaattcagctaagtgacgggtagtattcgagttttctgcacggaatgttgggccaaaagtataaattttgcttaatgcacaagcataggtttcgccgtttaactgacctgaaaccgttaaaaatgattctttaccgaagaaatcttggctgaaatccacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagacaagcaatgacgaacacgcgcgaccgcgccaataatattggtacgagggcgtaagtgagctacttcgcgtaaatattcgatagagtggcgttttgctgccattgggtaagtatctggatcttcaacaaaccctgtcacttccactttttctgcttgtaattcaaccgcttgtccttcagaaggtgattcaacgactttaccagttacaatcacagaacagcctgttgttaaacgtaaaatttcgctttcgtaatttttaatatcgttattaataattgcttgaattggatcaaagcaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcacataaaattgccgacagtttaccttaataaaggaaattttccataaaaatatagtgttggtgcgggctatgaacaataaaatcgccttaaaaatgagccctaaataaaatagggtaaagcctcattaatattgaatatacgcgattttatgttaaaatctcgggccaaaatcattatggctaataataggaaaaaatatgaaagttttagaaggctcagttgcagcacctaatgcaaaagttgcagtagcaattgctcgttttaacagttttattaatga

SEQ ID NO: 93 - DNA, 1547 bp, H. influenzae
tgtatcgattcggctcgtacctttttacgccttttactacgttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgagggtaccgagtccgatattcggtacca

SEQ ID NO: 94 - DNA, 995 bp, H. influenzae
  misc_feature (981)..(981): n = a, c, g, or t
  misc_feature (986)..(986): n = a, c, g, or t
agaatttgaattccctgtttcttggggcattgatctttcttctgaacacgaacgtttcttatcggaagaatatttcaaatcaccagttgtggtgaaaaactatccaaaagacattaaagcattctatatgcgtttaaatgatgatggaaaaactgtggcggcaatggacgtgttagctccaggaattggtgaaatcatcggtggttcacaacgtgaagaacgtttagaggtgcttgataaacgcatggaagaaatgggattaaatccagatgattattggtggtatcgcgatcttcgtaaatacggcagtgttccacattctggttttggtcttggttttgaacgtttaatcgtctatgtaactggcgttcaaaatattcgtgatgtaattccattcccacgcgcgccaagaaatgcgaatttctaattcaatttaactttaatattgaccgcacttacgccaaagtgcggttaattttttcagaattttaaggaaagtaaaatggataaaattaaacaactctttgccaacaattacagttgggcacaaagaatgaaagaagaaaattctacttacttcaaagaacttgcggatcatcaaacgccacattacctttggattggttgctctgatagccgtgtacccgctgagaaattgacgaatcttgaaccaggtgagctttttgtacatcgtaatgttgctaaccaagtaattcacacagattttaattgcctttctgttgtgcaatatgccgtcgatgtgcttaaaattgaacatattattatctgtggtcacaccaactgcgggggaattcacgctgctatggcagataaagatttagggcttatcaacaactggcttcttcatattcgtgatatttggtttaaacacggtcatcttctcggtaaacttctccagaaaaacgtgccgatatgctaactaaaattaacgtagcggaaccaggggtaccgaaggcccgnaattncggataaca

SEQ ID NO: 95 - DNA, 1632 bp, H. influenzae
  misc_feature (1236)..(1236): n = a, c, g, or t
  misc_feature (1318)..(1318): n = a, c, g, or t
agttttactgatatcagacctcggtttccttaataatttagcctgcaaacccaatgaaagttcagcaataccatcgagtaaaactgtaccctcatttgcgtattcaaaaaaaccatggtttcgctgtcgccaacttttcgaccaaacatttcactttcggcatcttcatcaggcaacccagcacaatttactgcgataaattttttatcacgacgtaaactctgataatggcaggctttcgctaacaaatcctttcctgtccccgtttcgccttgaattaacaaaggcacatcaaacatagcaaaacgtttcgcgttttctaccgcacttttcatcgcttcactttgtacaataaaacactcgaaaggtttttgtggattaaatttagaaatcgtcatattcagggaatggagataattaagatatggctatgataatttctttacaacaaagtgtaaatattattttacataaggtaaaaatgcgaccatttttgaccgcactttatatcgctaaggttttaacattttttcagcttcacgaacacgaacaaggaattgtttccgttcagctgaagtcataccactgctagtaccgggtaatttaacagtaagaggattcactgctcgaccgttaatacgaaattcataatgtaaatgcggccccgtagaaatgcccgtgttaccagaaagcgcaatacgttcgccttttttaacggtttgccctgcttttactaaggatttgctcaagtgcatataaacagtttgatattcacgcccgtgacgcaacataacataacgcccagcaccgccagcctgataagcgaccttttcaactgtaccatctgctggtgcaataactggtgtgccttgagaaacagagaaatccacgcctttatggggacgaacacgtcctgttactggatggcgacgatttggattaaaaggggaggaaactcgcgcttgtcgctgcaatggataacgagcaaaacctttgcctaaagtttccccttgctgattataataacgaccatttgccgcttgcactgcataataatttttaccaccagatgaaatacgtaacgcttcaacattaccttgacctgtaagtttatcgcctaaatattcacgagaaactataatggcaaattgagtgcctttttttagttttcgtaaactcacttgccattgtaaggcgttactaagttggctaatttgtcgcgtatcaagaccttgntctcttaaactactatttaaagaattttgaatctcgccttttaatacttcttttcgccaaatacttttcttttcaataactnggcgtttaattttccattctcgagacgttcataaatacgttcttttttttcagaaaccgcccaattaatattccaggtttcatttttatttaaaatcagaaaaatgctgacctgttttaagtggctaattcggatcaagctaatcaagggtggactgagaatcatctaacccaaataacttaacatcttttacggatcccttcgggtaccggaaacttattggacagtaattcttagggctgaacgcccgcgtctaataacatatgaggcggcttgggcggggtggggaaaaaccccgatactttgaaaaattt

SEQ ID NO: 96 - DNA, 1085 bp, H. influenzae
  misc_feature (121)..(121): n = a, c, g, or t
accgatatcggctcggtacccttttaatatgtatgtggcacgtggaatggaagatttgattatgcttgcattcgcaggaactgctatcgtattttttgcgtgttccgcttatgtattgacntacgaaaaaagatatgtcatttttatcaagcgcaatgttcgcattatttattgtgttattgcttggtatggtggcgagtttcttcttccaaattcctgcgttatcggtcgcaattagtgcattatttgtagtgttctcaacaatgaccattttgtatgaaaccagtaatattattcacggtggagaaacaaattacattcgcgcaaccgtgaacatctatgtttcaatctacaatttattcttgagtttattaagattactttctatcttttcaagtgatgaataatgattgaattttgactttatgaccccactatttagtggggttattttttggaataggcaatggaaaaacaaatttttgaacattcagttaatgtagaggaagaacactatcagcccaagcaagaattccataatatggaagcaaagctagatgaagcgttggatggagagttacttgatgctcaacttgaacaagcattgaaaccaaaatccagttttagaaaaactttattaaaatttaccgcacttttatttggcttggcgacggttgcacaatccatgcagtggatttgggatagctatcaacaacatcaatggatttatcttgcttttgctttagtcagtttgattatcattttattggggattaaagagattattggcgagtgccgacgtttagttcgtttaaaaaaacgtgagcaatggcaacaacatagtcagcagatttggttagaaagtgcggtaaaaaagggcgatgttttttccgttcataacgcacaaaaaggaaaaaatctctgtttagatattgcagattctttatgcttgggaaatgattctccagccggcatttcattggccacccccttttaattgaaagctttattgcgcggcatgaaaattgcttatttattccagtccgcctggttttgtgttttttttggttgcacaacctaaaaaa

SEQ ID NO: 97 - DNA, 930 bp, H. influenzae
  misc_feature (659)..(659): n = a, c, g, or t
  misc_feature (681)..(681): n = a, c, g, or t
  misc_feature (781)..(781): n = a, c, g, or t
  misc_feature (912)..(912): n = a, c, g, or t
ttcctacttcaaattgacgatatagtacgagagaacctttatcaatacttggtaatgtttgggtatgtaaggttattgttggcgtaagaatatcgcctgtaataccgtgttctgcattgctaatattttgataaagtggataactggttttagcttttccctgagcttgttttgttagtactcgaacaccaccttgtaaccatttttctggtgtcgcggattcaaaacgcaatccatctaatccaatgcttatatcgaaattggttgcagccacaaattgagtatcttcgtgaattaaattacggtattcagaggcaattgctgctttaaattgcacgccatttacatcaattgtttgtgaaacaatttgcccaattatcatattgttataaaacacattttgcccttcgctgacgccgtaattctctggcgcagtgagggttaaaactaacgtgttaggcgcattgagtaataattcattttctttaatcacgttaaattgatgtttagtttcgccgtctcccgcaatcacatcaaaatattcgtcacgaaagaatttttttggttctgctaaattgcctagatccatttttttattgcgtaggacaattttactatttgctttaaacaaagaggctttgttttggatcgatcaatanactgccttctaaatttcatcgntattttccaccgcacttagcttggcgagaatccctatagcattatcttgagaataaacttccgtttgcccctgcataagagcggatgatggcaggattgntacctttaatttcatccacgtttaccgctttaaattgtatagagcgtgaatgactatttcatctgctttgggctgcagctggagagtcaaagaaaccgcccctgtacacgcatttaacttctacatttagnttaagctgatggctatgg

SEQ ID NO: 98 - DNA, 1570 bp, H. influenzae
tgttttcgtattcggactcggttctcctccatcacactgcacacagccttgtagaaaatagtcgctccaagcaggatagcgagtttttttaacggggataatgtcataattaactcctttttagattaaattactattagtttgaaagtgatttattttcctgtcaagcacttgggaataaagtctgatcaaccaattcacaaagtgcattaatcacaaaaagatggttctctaagatacgactttctttggtggctgggattgatatttctagatccttatctgctaaaattccttgaatggcatcgttgttagagccagttagcacaataacattaacttctttgctgacagcatgagaaataatatttagcacgattttttctgtccccaaaggtgcaaaagcaataagtaagtcgcccgattttgcaatggcattaaattgatgacaatacaattcttcaggcggttgttcaaaaacaagtgaagaacccactgcactttctaagctcaataacacagacgggaagcttggtctaactaaatcatatcgattaagtaagtttgagacgagaaactgtgcattggcataagaacgcgacacgccacaggcgataaccttattaccgcctaataaacattgcattaccatttgtgtggcattggtaatattttcagaaagcatgctagatgctgcaatttgaatttgaatactttcgctataaatatcttttactttttgtaacattataaaaagccattaatcgagaaaattaggaatccattgaatatcttgaggtgttttgccaaaagcgattaaatcaaagcggcaattagcatcttctaagctcatattttgttttgcaagccataaatttgcggcatctaaccatttttgttgttttcgccaatctacgctttctatagcagaaccataggcggaatgacttcgttggcgaacttcaacaaagacgatagtttctttgtcattcattattagatcaagttcaccacatttgaaattttgattagccgcaataaatgttaagccttttgattctaaaaaaaggcgagcttgatgctcaaagctcgccccttgctgacgttttaaagaaaacattagtttgcaactggtacaattgcaccatcttgatattgataccaagtcatatcgcgttcaacattacagttggtatcagcacttaaaatccctgttaagccactcaagcgatagcctggcacttggcgtaattcatttaaattgattaatgagcaaccacgcatctgcacccattgcattataacgcatcaattgatatctcccccccgcggattttgctacttctgatatttgggacaatggtatcttaaaaatggaatatcactatacttgtccccgtcatctgtgcgatgaaatccgctttactggttgtcgactttgccctgggtcgaaaactgcataactcgtttaattagtgtccatttttgtgtaaacaccttccttcctgccatttcaagcggaattgctacgcctaaagtgcgggggttttgatatctatttgtgaccgaa

SEQ ID NO: 99 - DNA, 1624 bp, H. influenzae
  misc_feature (1120)..(1120): n = a, c, g, or t
  misc_feature (1213)..(1213): n = a, c, g, or t
ttaaaacaactttttgcaatcactgcaatcgcatcagctctcgttttaacaggctgtaaagaagaccaaaaaaccctgaagctgcagcagcaccgcttaaaatcaaaagttggtgtaatgtctggtcctgagcatcaagttgcagaaattgcagcaaaagtcgctaaagaaaaatacggtttagacgttcaattcgttgaattcaatgactacgcattaccaaatgaagctgtatctaaaggtgatttagatgcaaacgcaatgcaacataaaccttatttagatgaagatgcaaaagcgaaaaatttaaataacttagttatcgtgggtaatactttcgtctatccattagcgggttattctaaaaaaatcaaaaatgtgaatgaattacaagacggtgctaaagttgttgttcctaacgatccaacaaaccgtggtcgtgcattaattcttcttgaaaaacaaggtttaatcaaattaaaagatgcaaataaccttctttcaactgtattagatattgttgaaaatccgaaaaaattaaacatcactgaagtagatacttctgttgcggcacgcgcattagacgacgttgatttagctgtagtaaacaatacttatgcgggtcaagtaggcttaaatgctcaagatgacggtgtatttgtagaagataaagattcgccatatgtgaacattatcgtttctcgtaccgataacaaagacagcaaagctgttcaagatttcgtaaaatcttaccaaacagaagaagtttaccaagaagctcaaaaacactttaaagatggcgttgtaaaaggttggtaatttctaccgcactttaacccattactaaatcccttgcccagcaagggattttcttatctaagctcggaatgttttaaagaatattggtagctaaaaataattagataatacagaaatatgaaatttctttaattgattaaaaaagcaagatacttttacgcttggaaatgtttaattatagaaaagacaataattcagcgagagaatatttagattacttttagataaatttcaattaaatcaaaaattaagagtaatagcttcttttatcgacaaattaataagataatcaaagatattnttaccgcactttaccattacataaaaccaaatttcgtttttctgctcttttcaaataatttgacatgccctcaggaacatcacctgtaaacanatattccacatcacttaattcgcccagcgaacatcgcttgcgagtaatttagagtgatcggccactataggtctgacgtgaacttcaatatcgctcgtttacttgtacttcatgggatcataatccataatgaacatctgcatcatcgcactatccctaaataccgaatcttagcgaaatgagaataaaattaccggagcttcgccgatattccaccatcattctaatgatccgcccgcctaacatattcaaactttattttggcgaaaagattgacggattcagaatggcgcccatttttggatttttggggccaacaagcttggccacaccttggcggggtaccaaattataaaacgaggcccggtgggaacaacttgccttcctggcaatttttttttttaatgaaga

SEQ ID NO: 100 - DNA, 891 bp, H. influenzae
gccagcttgctgcctgcggtcgactctatgagaccccgcagcggtgctaggggaaggacgctatattgtgttagcccgtgaaatgactaaaacttgggaaacgattacagggaatacgattaaaaatttacgcgaatggcttttagaagatcccaatcgtacaaaaggcgagatggttttgattgtggaaggcaaaccaaagtctgacaataacgatgaaatttcgccgcaagcggtaaaggcacttgagttaattgcagaagaattgccacttaaaaaagcagcagctatagttgctgagttgtatggttataagaagaatgctttgtatcaatttggattagcgcatttggaaaaataacctcaaaatcaaccgcactttattaatccgattttaatctgtgctgttgtattaaacggatacaagcactcacaagatatttactttagactggaaaaaatatgttaaaccaagtttcaaatacattactgacaccaagtaatctttcaactcaaacattactcaatatttttgacattatgtcgcatcgcaatattgattatgccgatctgtattttcaacttagccaagatgaaagttgggtattagaagacggcattataaaagaagggcggttttcatattgatcgtggcgttggtgtgcgggctgtttctggtgagaaaacggggtttgcttatgcggatcaaattaatcttgcttctttgcagcaatgtgcggaagcggtaaagggaatgcgcaagtcaaacaggggaatttgatttcgctatccgcttttaaatgtggaaatcctattgctcgttatgcggcgattaatcctttggaaagtttgactaaagagaaaaaaattgagctattacatttgggttgg

SEQ ID NO: 101 - DNA, 1167 bp, H. influenzae
  misc_feature (1025)..(1025): n = a, c, g, or t
  misc_feature (1139)..(1140): n = a, c, g, or t
tggtatacgaatatcagtctcggtacccatttttttctattaatcctaacttaaaagacagaattaaagttagaaagtcagtaaaggactaagcttagtccttttagttcgtattaaataagaaatccgcctttaaatttataagtccatcacttattcatcaacaatatcagtaaattctgcacctaatacttttgctaaatcttgtggcgcaatttctacgcttagcccacgttttccgcctgaaacataaatcgtttcaaactcaagtgcggttgaatttatcacggttttcacgcgtttcttttgacctagcgggctaattcctcctacaagataacctgtacttttttgtgctgcatctttatccgccatttccacttttttcacaccgatagattttgctgctttctttaaattcagcatattggccgttgcaagcacaaaacaagcgagttttttctgatcgccattttccgccacaagtaaggttttaaaagagcggttaggatcaatgcctaatttttcggctgcctcatcaccaaaatgttgattattcggatcatgatcataagtgtgcaagataaaaggaattttttgttttttaagtaaatcaattgcgggtgtcattatttcgttcctggttttggtgtaaaataatgctgattattttacagcggagagaaaaatggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaaggtgcccatattgcgcaagcagcagaagcagggctgtattggcattgatatgttagggcgttggagggcgctttcggaagggcctggtggtggttcaacgggnaatgaaacacccctacttgacaccccacaccgaacactggtagcttgcccggaccttaaggaacccccctgttttaacccctgcccccgatttccacaaaacaaactccacccnntttttcccccttttcaccccgactcct

SEQ ID NO: 102 - DNA, 1208 bp, H. influenzae
ttttgagcgtttcaaaaatcgtttcagcaagtttaagggaaattcccggtacagaggctatttcatctaaggtcgcctttttcacaccttgtaaaccgccaagatatttcagtaaagcctgacgacgtttagcgcccacaccttcaatagtttctaaaccactttgtgtaaaggctttttgacgttttttacggtgtccgcttattgcgtgattatgactttcatcacggatgtgttgaatcaaatgcaatgccaaactatcatcaggcaaatgaatttcgcggtcttgtttgctgatgatcagtacttcctgcccagctcgacgatccacaccttttgccacgccaattaagtgcggtctatttttatcccattttacttgaagatgttggaacacgttcagcgcacgatttaattgcccttttccaccatcaataaaaataatatcaggaattttatcttcttctaaatcacgctcataacgtttctgcaacgcttgttccattgctgcataatcatccccaccagtaatgccttcaatattaaaacgacgataatcagatttcagtgggccttcttgattaaagacaacacaagatgctaccgtttgatttcccatcgtgtggcttatatcgaaacactccatacgcttaatttcagggagatttaacagatcacacaacgcttgataacgctctgacattcgtgaagattgtttaagttgtacatttaaagccgctttagcattaacttgtgcgagctgtaagtatttactcttatcgccttttacactttcttgaatcgtcacttttctgcctgcttgctccgtaagaagttgctcaagctctgatttttcagctaattgacgatcgacaataatactatttgggatacttcgcccttgatgaccttgtaaataaaattgccccacaaaagtttcggtaagttccgataaatccgtattggcagggactttttgggaaataactgcgattgcctagcacttttccttgacgaataaacatcacttgtacacaggctaaaccgtgttggtaagcgatggacataatatccatatcatctaaacgttcattggatacaaattgtttttcataaccgaacgcacgcctggatttgatcgcgatacgagccgcctgttcaaaactaaattctgcttgctgctcattttccgataataatctacaccg

SEQ ID NO: 103 - DNA, 1106 bp, H. influenzae
  misc_feature (918)..(918): n = a, c, g, or t
  misc_feature (997)..(997): n = a, c, g, or t
atgtaattcctcttgtaaagggcgacaaagcaacccaaaaaatatcttggcttttagatttttcactaaacctgattgcaagtgcggtacaacagaataaaaaacgccacttgctaacgcaccaaaatcggttgaaggtacaccggctaaaaaagcaaattctgatttccacgttgcaccagcaaaagtatgtacacgcaacggcgaagcaaatactgtatcactttgagactcaaacatggaaagtggtggaatagattgctgactaaaagcaaattgatgagggttcagcgtggattccattaatgttacaacaatatcgggttttgtttcagataggttgtttgtatcagatgaaagtgcggtcattttttcaataaaattttggctattgccatcaaaatttggcactttgaaaaaaataccgcgacaagacattggtaaatttaaaaacacatcacgaccatcatcaggcaaagaatctaaccaaacttgcaccgcacttggatttttagaataatgccacatcaagctaaagctaacgataaacaataaagcaccaatgctgttacccaatacccctaaagactcgacatcattaaaaccaaaaatcgcataacctaataacgccagtagcccaataacgccaaacaacgcacctttataatgaattaaggtttcccaatttcgccaatccaccacaagaaagaaatctgaaattaacaaaggctgtttgtaataatgaatttttaaacgatgaaataacatcagcactacaaaaagcactgatgaaaaatttaaagcacgttgccattggctggaaaccataagcatgccgccaaataaaaaagtaaaaagcgtaatagcaaagaaataagtccaacgataatgggagtttacaataaaaatcactgccgncatcgtgaataaagctaagaaaatataagcgatcataaaatttccctatgatatataaacagttaaaattagatatgancatgcctgcgcacttttatcacgtaaacgtatggattgaaccggaaaagaaaaatattgggataatttgaaaataaaggggggggcgataccggtctcgaaacagtgaa

SEQ ID NO: 104 - DNA, 669 bp, H. influenzae
gccagcttgctgcctgcagtcgactctaaaaagacccctgatgaaaacaattacttactggggttaatatttatactctcctctagtacaggaaattattagtcttaattaaataaaaatatttttactcctttcttttaagaatccgctatttttcttagaataaaggcaatatttacccaccttataaggaaaactcaatgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgggtaccgagtcgatattcgatacca

SEQ ID NO: 105 - DNA, 728 bp, H. influenzae
tttttgattaccctttagctggaaaattacatagcgcaggtcgcttagatgtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaataatatgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaa

SEQ ID NO: 106 - DNA, 951 bp, H. influenzae
tttcaacccgaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagcttcctcctgctaccgttcgacttgcatgtgttaagcctgccgccagcgttcaatctgagccatgatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttattgcactgacctggcgcgctcgacaagattcgaacttgcgacctttggctccggaggccaacgctctatccaactgagctacgaacgcgttactgcgtcgtcgttgcgggggcgtataggggtcctataagtcgaccgcaggcagcaagctgcc

SEQ ID NO: 107 - DNA, 864 bp, H. influenzae
aagatgtaagcccccttccgtcgcttcgtgacaccttcccccgcagcaggggaaggaaagatttggttgctttatttttttacattatcaattcgattttttatggcgaggagcaagcctaagcctataaatgcgcctggtggcagaatgaaaagtaaaaagctactgtctgtatggtaaatatggtgcgttaaaaattttgcttgttcgccgaatagattttctatgccctcaaaaatcgtgccttgtccaataatttcacgtaatgcgccgagaatggttagactaagtgccattcctaatcccattgaaaacccatcccagatggaatggagtaagctgttttttgaggcgaatgcttctgcgcgaccgataataatacagttggtcacaattaatggaataaaaatccccagtgattgataaagcgtataagtgtaagcattcattaaaagttgaaccgctgttactgtggttgcaatgatcatcacgtagattggaatacggatttccttaggaatatattgacggaaaagggaaatgaccgtatttgtgcaagtgagtacaagcattgttgctaaacccaaaccaagcgcgttggtggctgtgctagacaccgctaaaagtggacaaagcccgagaagttggacaaccgcagggttatttttccaaattccttgagcaaaaatttctttccagatggatttttgttgattttcaaccgcactttctattttttcttcttcaaggcgggatttttttcagtccaacccgtcatattatttcccttgtgttgaaagctgccgcaccatgctttgttttttatcttgattatgctccccgctcaccttgatatcccctcca

SEQ ID NO: 108 - DNA, 1855 bp, H. influenzae
  misc_feature (1564)..(1564): n = a, c, g, or t
  misc_feature (1586)..(1586): n = a, c, g, or t
  misc_feature (1608)..(1608): n = a, c, g, or t
  misc_feature (1625)..(1625): n = a, c, g, or t
  misc_feature (1632)..(1632): n = a, c, g, or t
  misc_feature (1637)..(1637): n = a, c, g, or t
  misc_feature (1669)..(1669): n = a, c, g, or t
  misc_feature (1678)..(1680): n = a, c, g, or t
  misc_feature (1686)..(1686): n = a, c, g, or t
  misc_feature (1700)..(1700): n = a, c, g, or t
  misc_feature (1707)..(1707): n = a, c, g, or t
  misc_feature (1734)..(1734): n = a, c, g, or t
  misc_feature (1807)..(1807): n = a, c, g, or t
  misc_feature (1851)..(1851): n = a, c, g, or t
ctgcttgttatgcgtaaaagcccaacgcccagcaacgcgatctttatttaattttacgaaatcataatctttacgaaagcttatcaaaatttgcacgcacaaccgcaggcatcgcatcaactatattgccactattaagcgtaaatgcttgagcatttggctgaaaataactgactaaattatcacgttgaataatttctttctggcgaccatctaaagtaactaattgtgcgtaggttttgttatcttgtttgatatgtcgataacgaaatgaatccatatttgctggagtagtttgcacaaaggcaatttcataattgagattatccaatgcttgtgtcattttatctaaagactgcttcgcagaaagctcttcagcagaagcaatgctacttaatagcaaagaaagagaaagtgcggtaaattttaatgcgatttttttcatagaaatctaaaggataaaaattcaccacactaaataacaattaggtggtgaatcaataatctgaacaaaggaaaccaatttatcttacttgactgctagcatcagagtgcatacgacgttgcaattcatagttttgcaacattgcaccaatacgacgactttttttctcaagctgatctgaagtcaatgtatctttacttggcgcattatagctaacctcttgaaccgcattattaaatggcaaggtttgcaatactggagcctcaggtaaattagacgcttcgtttttactattgaaagattgaacaccaagtactgccactaaacatacaccagcagcaacagcaacttgcgtcattggcgcaaaaaatgcctttaatttttgcataaatgcagaattatgtgcatcttctggttcaggttgagacaccgcaatgacatcgactttcttcacgtcttctaactcaatcaaatctgccattttagcggtaaaatccccccctaaaaagaccgcactttctttacgcattactgaacgaacggtatgaaatgaatgccaagacgcttgtaattcttcgtctcttaataaagcatctgtcaagtcagttttgacttgttcgccatccatataggctgaaagctgctctttttgcatagtaaactccaatttttattcgctctacattagaggttgaattttattttcgatcatttcccttgctcggaagattcgggaacgaaccgtaccaacaggacaatccataatttctgcaatctcttcgtaacttaaaccttctagctctcgtaacgtaatcgcggtttttaaatcttctggtaagttatgaatagtatcaaaaacaattctttctaactcactagacaacatttcattttcgggtgtatccacatcccgcaagtgcgtacccacatcataattttcagcatcttctgccaaaatatcttcatttggtggacggcgaccttgagccgttaaataattttttgccgtattaacggcaattcgataaagccatgtatagaaagcactttcgccacgaaaagattcaattgagcgataagcttttataaaggattcttgcaccacatcaggaatatcgntacgtgatacatagcgagtcanaagccccgccactttattctgnatacgcgaaaccaacanattgaanggctntcttatccccttgctgcactctttctacaagncctgattgnnntagctngtcagccatatttnctctatngccatatctaacacgccccttatattncagacagcagctcttgctgcatctcaaaccagggtggtggaaaaagttcatacgatcttataattaaaatagnggggatttttttggacgttttgtattctctacatagaatgattntgaa

SEQ ID NO: 109 - DNA, 759 bp, H. influenzae
  misc_feature (603)..(603): n = a, c, g, or t
ggaattcggctcggtacccagaatttgggggcaagatgtggcaccgattcaaaagcaaattgaggctttaccttgggttaaaggtgcaatcgtaagaaaaagtggccaaatcgtttaagtatttgggtatcagaatatcaacctgttgcgttttggaatcaaaatcaatttgttacccttgatggtatcgtttttcagcttccctctgtacgtttaactgcaaaaaatttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacatagtaggtttagaggttggcacgtcanaagtggtcgctgtagttggcgaagtatttcctgatggtgtagtgaatgtgcttggtgtaggcagttgtccttcaaagggattgatcgtggcagcatcactgatcttgatgccgtagtgggttcgattcaacgtgctattgaagcggcagaatctat

SEQ ID NO: 110 - DNA, 1251 bp, H. influenzae
aaaatctccttatttacgccaatgcgtacattgttaaatatgtaaacacccttatctgtttagataagggtgtttatgttagtaaaacattggctcattttcccaatcaatgtcaagcgggggttcttctactggttcaggttcaataacttgatattctgcttcagtataggaatctgcactctccaattttttgttccaatttcccattatgtgagcaggtgtgtataaatggtaattcacctcatctttaagggtgttaccaataatgacttctcccggtatatgcaagagtgtcatttgtatataacacattaatgctgcagtaaaatccaaatctcttgcttgagcccacatttgttgctgagggttaaagtcctcttcacgcaaataattataagcctcaataatcattacgcctgacccacaagttggctcttgcaatgtcaaaaagccacgttttttaattaaactatgacaatctgatagagttacggctgccattaagtgtgcaatgtgactaggtgtgaaatattgagctttatattgatcacctaaatccaacgacatgaacactgatcctaggaaatcataggttttatgctccaaagcctcaacaataatgttgaaaaggcgactgagagcttgtttttcatcttcattataatgctcgccagctgtctgataacgttgtctcaacgattcatctgcttgtgcaccatatataatgagatagaattccagggcaaagattgtaataaagtcgtaaaacacttctgagcgtcgatattgtggtgctatcgatttaaaaagtgcggtaaattttttctcgaaatccatagattactcctaaaataacgggagcaatcccctttgaggattactccccaaagggtggtttatgagagctctaacaaaaaacgttagaatggtttaatagaggctaagccgctaattttgcttcttcattcgatgttaattcgagagcatttaacaagaattgtgttgcttcacgtgcttgagaagatgctcggaaaatagcttttttatcggcttttaatgcgttaatccaatgttcaatatacgctgcattcttgtgaaaattattgcaaacattcacgtgcgcacaggtaaaggggcttgtgagttcacctattaattttcaaatgctattggtcagaaccaatttataaattaaccccccgtcccgattaaccggccttatgcccggtggcggaccccgttctgcag

SEQ ID NO: 111 - DNA, 1487 bp, H. influenzae
ggtaccgaatatcggactcggtaccctcatggaaccgggcaaagaggggctaatgtcaaaacaacgataagcattgctgggaggagttcgattgtgagccagcggattaataaatcccctttctcaccttcatcatccccttgtttagctacgtcacgccaaattttaaagatcattccgataagcggaagaagccataaccctgttccaacaaataacgcaaaaactccgttattaagcaaccaaccaagtagagtcaggaaatattcaagataactgtcaactgagaatgtcatatttccccctaagctaaagtaatctgtgtaatcgcttcagcaaaaattaaaatcatcgcaattaaccattttgcttttgccggcatagaagatggttggcgacgagaaatggaatagaccatcaacataatcgcaccatatagtaataatcgtactgcaaaccatatccactgcgttttaataaaccaagcacgaatatcaacattctgaagatattgagttgcaaagatgccaattgcagtaagggctaaaaataaaaataaaaggatagcaataaaacggagtacatttttaagccatcctcttgattgtggctttttaccttgagacatcaggactccttattcattacccacagtcttatccccaaaaactggggataagtcagcaggggattcccaaattgcagctaatttccaaagcaaatattgaattaaccaatatgcatcaacgtgatcggttaattccacattaagtctagctggccagttttcggaagaaacacaggtaattggaaacgcccggagatattaaataataaatgcacttcacctttatctcctttagcgtgtactttccaacttgattgagtaaatacacgctgaggaaatgcgcttaattggcagtttgaaccaatttttgtcttaatttttgcaatgaaatgcagcacgtaggctttcacctcatcagaggtaaaagcaagtgattggatgcgaggcccaatgtcaaaaatacgatgaaaagtcatattaggattaggctgcgattgagttaagttcgtcattgactgcaatcccccgttttttgtctaagtctttagcaaccatcaatgccgcatctaactcagtacagttatgttccatcattaattgtttacgttgtgctttctcgtgtttttcagtcatccctagtgctaagtaaagactaggtggaacaacacggaataaggcttccatattggttgcgagcaccacaccttcagtatatttcttatctgcttttttcgcagataacaacatcattttctgagcttcggataaacgacggaaacggtttacctgttcgacttcatcattagaaaggttaagtaattcccaccattcaaccatgctgagtaatttatcagattcatcagggaagtcagccatattctgtgtagctaaccataaccaaatacccaattggggtctc

SEQ ID NO: 112 - DNA, 1059 bp, H. influenzae
caattaaacgaataatcgttgcttttctgaagcggcggcgtatattgtgggctagttggtccataaagtgcaatcaatggacgatttactgctgccgcaatatgcattaaaccactgtcattggtcacgaccgccgtacaatttgcaattaaatccactgcttcatttaagttggtttttcctgctaaattgacacaaaactcacgcaacgcttctggcagtgcttgacgaatttcttctcccactggttcatctttagctgaaccaaatagcgccacagcatagccttgggtaattaacatttctgctaattttgcataatgataatgtggccaacgttttgccgggccaaattccgcaccaggacaaaaaccaataattggacgctcgcctaaaagtgcggtttgttttttaaagttttttaaggtttcagcttgttgagtgggatcaacggttaaataaggttttagaacaggaatatcagccgctttcggtaccgcattttgctcaaaagctaacgcgacataacgttgcaccatcataggataatcacgtttattattgcgtaaatcgttaagcaagaaataacggctttcccctttccagccacgacgcaccgcaatttttgcaaaagcgggaataaaagctgacttcaaggagtttggtaatacgatcgccatatcatattgattgcgcaatgccttacctaaacgataacgcgttcccaattcaaaggctccgtgccctaatggcatttcaatcgccttacgcacttctggcatacgcgcaagcaaaggcttacaccaattcggtgccatcacatcaatattgcagtttggatattgaattttcagttgctggtacaaactgtgcgacatcatcatatcgccaacccaagatgggccaataattagaatattcattttctgtctttcagaaaaagtgcggtcaaaatacttgttattatggcacagagttgaataaaatatgctcctttaccatttagtcgaactctttaggagtcatttcaaatcctttctaaaaacagataaaaaattg

SEQ ID NO: 113 - DNA, 1043 bp, H. influenzae
  misc_feature (858)..(858): n = a, c, g, or t
  misc_feature (905)..(905): n = a, c, g, or t
  misc_feature (924)..(924): n = a, c, g, or t
  misc_feature (936)..(936): n = a, c, g, or t
  misc_feature (963)..(965): n = a, c, g, or t
tgttaccgaatatcgactcggtaccccaaaaaagtaattttatgtttgtttggttattaatgaagcatatcacttattttttattcatttaaacaacttatatggctttctcaacagccaaatttttcctaatcctattttttcttttatgcgttcatttattgttaattaaaatttatttgacaaaaaatgcctaaatcgttatttctatacccactattctaaaaaaaacacaacatctaggagtatcttatgccccatctctcagtcgccaaatttggcggaacatctgttgctaactacaatgcgatgacagcttgtgcaaaaattgtcattgccgatcccaatacacgcgtagttgtgctttctgcatcagctggtgtaacaaatttattagtggctttagtaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgaataaaatttaaacctaaagtgcggtgaaaaatcaccacacttttcttttatatcattgagattaaagccgaaaaagagtaaagtaaacggctgttcatttgactaattaaccgaataaagggcggaattatgggaaaaaaccggttgttatctttaagcgcacaatggggcgatggaaggtaaagggaaaatccgttgatcttttgacggatcgcgtaaataaccgaaattggttatcaaggcngggcataacggcaggcacacacttattatcaatggcgaaaaaacgcnattacgttaaatccatctngggatgttacanccaacgtaactgcttattggaaagggnnngtggggggtcccctgaaccataatgaaagaatggccaactgaaagcagtgttttaagttcgggacggctataatttag

SEQ ID NO: 114 - DNA, 1017 bp, H. influenzae
  misc_feature (828)..(828): n = a, c, g, or t
  misc_feature (875)..(875): n = a, c, g, or t
  misc_feature (890)..(890): n = a, c, g, or t
  misc_feature (892)..(892): n = a, c, g, or t
  misc_feature (944)..(944): n = a, c, g, or t
  misc_feature (968)..(968): n = a, c, g, or t
  misc_feature (971)..(971): n = a, c, g, or t
tagggaaataaaacgtgacagaagtctatcaaaatagagcgcactttgcatataaaatcacataaaaaaaagcgggcatagcccgctctcttatttgcatcatcattatgctgcgtttttacgttcttcttccatacatactgccgcagtaaataatacgtcagttgatgagtttaatgctgtttcggttgagtcttgtaaaataccgataataaaaccaacaccgatcatttgtgctgctacatcatcagaaataccaaataagctacatgctaatgggattaataataatgaaccgcccgctacgccagatgcaccacaagcacaaagtgctgcaacaatacttaataaaagcgcactaacgaaggaaacttctaagcctagtgtatgaactgcggctaaagttaagatagtaatagtaatcgccgcacccgccatattaatgttcgcacccaatggaatagaaacagaataagtttcttcatcaagatttaagcgttttgctaattcaatgttcactggaatatttgctgcagaactacgagtgaagaatgcagttaccccactttcgcgtacacaagtccacactaatgggtaaggattacgacggattttccaataaactaaaataggatttacaacaaaagcagtaaataacatcgtaccaattaatacagcaagtaattgcacataaccggcctaatgcgactaaacctttatcagataagggtttcagccactaaaccgaatacaccaaatggtgcaaaaagaataatcacgtgaacaatttttgatacgccttctgcaaaacagaaatacgttcttagntgcatcagatgcatgacgtaagccaacctaaaccgatagaccatgcntatacaccaataagntntgcttttgaaaatgcatttaatgggatatctaccacgtttaagaataggggntaataaaactggccacgctttggnggngctgagctgcatctcctttggttgcagacaacttcgctgggaatcg

SEQ ID NO: 115 - DNA, 1223 bp, H. influenzae
  misc_feature (100)..(100): n = a, c, g, or t
  misc_feature (1160)..(1160): n = a, c, g, or t
  misc_feature (1197)..(1197): n = a, c, g, or t
gccagacttggcatgcctggcaggtcgactcttaaaggatccccaattgaagcacctgcacatgaatataaatcattaaaagaagtaattgaagctaccntatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcctaattatagattatcaaatctggcagatcttttatttaaaataatgtgtctgccagattattttattccaaattttccaaaatattttctattgcatattttgagttaatcaaggtattataaaaatgaaaaggatttatactgatgaaccaaccaaccaaccaaccaaccaaccaaccaaccaaccaaccaaccaaccaaccaaccaaccaaccaaaataataaaaccgttgcggtagtaacttcaacaataggtcgtccagaattatctttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagnttggggttaataggtcaaacttcaggaaatataccgntaaatacagagctgattcattaacta

SEQ ID NO: 116 - DNA, 1099 bp, H. influenzae
ttcacaaataccaatttcactattgaagaattaccgaattaaggaaaagctatgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaaacgaaaaaacgcaaaatgaaaattaaagatgcgttgaaaacgttgattgatgatgaagcagcgaaattaattaccctgaagacttaaacaaaagccattgatgctgtggacaaatggtatcgtctttatcgatgaaatcgacaaaatttgtaagaaaaggtgatacaggggtgcttgatgtattcggtgaaggtgtgccacgggatttactttccttaggggaaggctcgacagttacaccaacccccggaaggttaaaccgacctattttatttatggctctggggcttccaaggtcgtcgcctctaaatttaatcctgaatacagggcgtttggcgattcggtgaacttacccataaggggggggatttcggcgattttaaaaacttccgctttttaccgaataaaaagctt

SEQ ID NO: 117 - DNA, 905 bp, H. influenzae
  misc_feature (826)..(826): n = a, c, g, or t
atctaacctacatttggtagtgttcaactttctaccgcagaacaacaggcatttctgtcgcacttgttcttgctttacaatctgttggtggggcaatggggaatatggtatgtataaataacattgtagcggtaagttcagtgttaaatatttcaaaccaagaaggcacaattattaagaaaaccattatacctatgatcatttacggtatcattgccgcacttggcgcgctattcttagtacctttattttataatctataaaatttacgccaaaaatgaccgcacttttgcggtcatttcctatttttctcttttatgtttctactatcaaaaatgagctttaacccattaaagtgcggttaatttagcgaataaatttgtccatttcgcaaaaatcaacctttctttttctctatcttctaaacgtgtttcctctctaaaaaattaatttttttcattatttttttaggtattttcattaaatttattaaatcattccttgaaatccctcttataaaatggataatcgtaatatttctcaaaaataaataggaactataatgaagaaagctataaaattaaatttaattacacttggcctaattaatacaatcggtatgacgattacacaagctcaagccgaagaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtggtcgnttctggtaatattcgtggcgaaaatggattatgtcgtgtcatacgatgggtgatggggtaccccaacctctattctcag

SEQ ID NO: 118 - DNA, 1247 bp, H. influenzae
tctctgcacagagaaaaggcgtttcaatgcgtaagttgtacgcgaaaattcagccaaagtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggcttaataaaaaacaaactattaagcaagttttaataggtcttaagtaaggaaattcaaaatatataacacattgaaaaataatgaattttaccttttaagcaagatttggcatgaaataagcaaggaataataatgacagaaccgctttctaaaattaacggcattatcacaaaaaattatttagagatgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgatatatcttagatttattataccagccaaatttattacccaaaaggaagtcggtattcagtttaaaaatcagccatttaactttttctacctgccgggacgttacattccttcaaatc

SEQ ID NO: 119 - DNA, 1716 bp, H. influenzae
  misc_feature (1448)..(1448): n = a, c, g, or t
  misc_feature (1576)..(1576): n = a, c, g, or t
  misc_feature (1605)..(1605): n = a, c, g, or t
  misc_feature (1614)..(1614): n = a, c, g, or t
agaaaaggggggagggagaacggcaaggcgaaaggaaaagagcggaaggggaaagaggaggaggcgaaagaggggagcagaaaaaagaaaagggacgggaggcggaggacagaagagtgaagaaggaatgggggaaattaacgccaagttccgaggaaagaagaggggagtaaaacagaagagcgggtgggtcaaccgagggatgaaaaccgaaccgatcggatgagtaaaaggagatcttcatcagggtaaccgacatcggcaaacgccgtgatgattaacgttctttttcatccgccacaattaacatcgcttataacttgcgaagtgcgcgatctgtacgccaatctttcgctaattccaccgcactttttagcaaatgcccttgatgcatttcaagtttacgttcaaataattcaaaaagtgtaaatgcatctgccgttccacccgcaaaaccagcaagtaccttaccattatataaacggcgtactttacgagcattacctttcattacggtattgcctaaagaaacttgtccatcaccgcctacgacgacttgcccattgcgacgtacgcttacaatcgttgtcattgttctgtcctttataaagtgaaaagttgttcgttatatggcgacaaattgattaaattcaagagggaaatttatattgtagatttattcttcactcataaataaaaaatgtgaagttgatcatattttgagatggcaaacgattgccaattattgaatataagctaaaaaaatgtatgatctgagcggtttttaaatcaacgtttgtgaggaaaggcaatgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcanactctacttatcaaccaatgccaactttaggcggctatggcgaagaagtgttaatcaattcaagctattaattgaccgcaagttgggatttatcttcccccaaaaagttagattgatttagttcaggnactgagttctgtcattcacagggctcagnccttttagnttccctgaatgtgatcatgggttgtataatgaatatactcatgaagttgtttttcaagtgtttgaacgtctcaaatcgtttgtcgtaatacaattcagttta

SEQ ID NO: 120 - DNA, 1331 bp, H. influenzae
tgcatcatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgtgctgctcgtcaagcaggtttaggcggtgagatcatctgttatgtagcttaatagagaggtaggaaaatgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgagccttatgaaggtataggggtacgttattcttatgatgtgttacatttcacaaatgcttcgaagaaacactctaccttatccttttccgataacgtaactttcttctgcttccctgtccgttctttctccgtctcttattttcttttcattggtttatttcgcgcatttttctctgtttcagttgtgttactttcaccccctcctcagtcgatttttctctctcgcaggctttttcctcctctcctctttttgttttttattttttgcgactgtcgttcacttctttgcttttgcttttttcattctcgcctctcctctcattccttcctttcatctcctactcttagtcttttcctccctccccgccccccttcctcccctcggctattagtcggctcctctcattttttttctcttccttcatcttttctcccttccccttcctctcttgcttctttcttcgtcttacctccttgactatctttcactttcgtcctcttctttttcctctgcccccctcattttccg

SEQ ID NO: 121 - DNA, 1283 bp, H. influenzae
  misc_feature (802)..(802): n = a, c, g, or t
  misc_feature (969)..(969): n = a, c, g, or t
  misc_feature (1069)..(1069): n = a, c, g, or t
  misc_feature (1092)..(1092): n = a, c, g, or t
  misc_feature (1099)..(1099): n = a, c, g, or t
agctaggccgtactgtttttcattactaggattaagtacaacgagtatatttttaaatttcataatagcctccaaaattgaggcataggataaaaaagaatagcaaaaatggcaaggtacaagattaatttggataaatttatttttatcaagcacaaaaaggcgtgatattcacgccttaaatttatttaactaatgtaatttttgttttattcgtaccagttaattcaattaaaccatttaaatcattgattgtaatatatttgccttgcacgctaatcacgccgagtttttgaaagcggcctaataagcggctgatggtttctactgttaaacctacataattaccaatatcgccacgtgccattgttaaacgaaattctcttgctgaaaaacctcgagcagaatagcgtttagaaagattatgaataaaagcagccaaacgttcttctgcattcattttagatagcaataaaatcatctcttgatcacttttaatttcactgctcatcaaacgtaaaatttgctggcgtagttttggcatttttcctgccaaatcatctaaaatatcaaaaggaatttcacataccatagccgtttctagagcttgtgcaaaactagggtgttgcatttgagtaatggcatcaaaaccaactaggtcaccgggcaaatgaaatgaagtaatttgttcttcgccagattcactaatcgtatagctttttattgtgccagaacgaatagcataaattgaattgagagaatctcctgctttaaacaatacttgagacttttgaatcggttnttttctctctatgatattatcaagctgatctaattcttgttcatttaaggtaaaaggaatacaaagctgactaatactgcaatcctgacaatgaatcgcacaaccgcctgattgaattttgcgccctgattgagctcctgcaacgaaatttttcatgtacgtctcanatattgaaaaaaatagtgtaaaattgatctaacgcaaatattctaccactaattagtcagattaagaagagtaaagcattatggcagctgaaaattacanaaaaacgttagctcaatttaatnatggtgngcattttattatggcatttgttgggcgaatttttagaaacagaaattctgcttattttaaacaagggatattccaataatttgctgtcacatctattatcgataatcacccatagccgggggcaaaatggaacccacggatcaatccgcgtgaaaacggggggtcgatccacctagcccatcaa

SEQ ID NO: 122 - DNA, 1487 bp, H. influenzae
  misc_feature (1436)..(1436): n = a, c, g, or t
  misc_feature (1459)..(1459): n = a, c, g, or t
tgtatacgattcggactcggtacccgcactattaattttacgccttttgaagcgttggagtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaataatttgatgttgtcgttatttcatcatccacaacttcgccctcgtcattatgcgggcggggttgttgtcattagtttcattattcttttttatggcagtgccttaagttcgatctttacattgggcgatgaattgcaatggcgagcttggttcactgatgattacctacagcatctgattcttttcagttttgggcaagctttactttctaccgctttatctatcttctttggtttactcctcgctcgggcattattttattagcccatttttggaaaaaagtggggtgtcaaaattaccgccgctaacttttggccttacctgctttactggccacttttggttttgaccgggatttatggcttcacgtggggtgtgcagtctgggtttacctatctttttctcaattgtccgtctggtgcgtttttatggatctgagggttattaaatttgtcgcattttattttctaattcctacaacatcacatcttttttcacacactctttataccatcccttataaatcctcttctgctagatcatctctaactccccacggtaattctttattgttttangctgttgtatcatcttttgtttnattaatctgcatgacatatttactctcc

SEQ ID NO: 123 - DNA, 1494 bp, H. influenzae
  misc_feature (1442)..(1442): n = a, c, g, or t
atccccatcatgtaatcttaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaattttataataattgaactttcaattgataaaatctgtcttattgacaaattagttcaataagatagcttattgtgctataactaagtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgctcttcgtaactggcgtatcgtaaaagtcgcaaccacgaaagctcaccgtaaattatttttcaacctacgtaaaactacacaacgttttaggttggttcaatgaaaatgaagttgatatggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaggtcttaatcttatcaaacacttggttcgcctcgtcatattccttattcaaataacgtaaccactgtttaattcgtgccacatggtaaaaaccgctgtcatattcattttcgaccattagcatatttttgcaagattttttgaatctcataccaaggcatntggatgctgccctagcaacgccagggtaccgagtccgatattcgtataacag

SEQ ID NO: 124 - DNA, 1872 bp, H. influenzae
  misc_feature (1495)..(1495): n = a, c, g, or t
  misc_feature (1514)..(1515): n = a, c, g, or t
  misc_feature (1547)..(1547): n = a, c, g, or t
  misc_feature (1591)..(1591): n = a, c, g, or t
  misc_feature (1620)..(1621): n = a, c, g, or t
  misc_feature (1630)..(1630): n = a, c, g, or t
  misc_feature (1653)..(1653): n = a, c, g, or t
  misc_feature (1666)..(1666): n = a, c, g, or t
  misc_feature (1676)..(1676): n = a, c, g, or t
  misc_feature (1696)..(1696): n = a, c, g, or t
  misc_feature (1700)..(1701): n = a, c, g, or t
  misc_feature (1825)..(1825): n = a, c, g, or t
  misc_feature (1847)..(1847): n = a, c, g, or t
actctaggagatcccctttgcacaacgtttaaatttaccagtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggtttttggttttcctgcggcacttggtgtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaactaatgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaatntgttcgttctggattgatnntagtgtgtctcgtgggagaaaagaatattctnttaagtagggggcgtaaagtgcggaaatattttaaatagaattntaccgcactttattagaatataaaattgnntttttaagntttttttataaaaaaaattgtgnaccaagttcacanatctaaaatnatgtatttgcataactgaancggnnattctttatttctgaaccactaaaaacaagtgctatcttaatagccgcatctatttgctttccccgagagtgcccatggggcacttttttattagtaacaatataaaatcctttctgaaaaggngatttatatctaatacattttntacggttatacgggacgtaactgtt

SEQ ID NO: 125 - DNA, 1618 bp, H. influenzae
  misc_feature (1574)..(1574): n = a, c, g, or t
gaaaaataaagccctttttttaattcagggcatgacgataaaatcttgttcaagaaaaaattggtggagtgccggagcaaattccggtaaaccatgaatggtagtcaatcaattcgggaagaagttggcgtacaaagggattctagaaccccttgcataggcgcaagaataacacgcactatttccagccttttgctttacaaattaaatcgtaagcggcttgaatctgttgagtttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggccagaagcatgttggtaaccaccactattttgttgttgatattggtagccaccttgatatgcaccttgttgatattgctgataaaaaccgccttgagtaaaagctcgagcagccatttccatcgcaatcatttgttcaaattgcatacgagaaagcccaagttcttcagcgatcacataaagcacttctttctcattttcgtgaagttctgaatcggcaaaagccgcttgaacttgcacttgtaagaacattcgcaataaatcagcacgttgcccacaaccaatgcgaaattcacggataacttgacgaatcgggaaatcagattctttaccacgacgaaacgcatcttgcgctaatttacgcccagcatcatccagtttaagctgaatcattaattgattagctaattgaatatcttcttctgttacacgccctttcgatttacttaaatgtcctaacaccgcaaaggtggtttgcataaacaagtcttgacgtgttgttttctttttaaagaaactagaacttaccgagccaagctcatacaattttttatctgcaatagagcctaaaatgagaccagcaatcgcaccaaaaaatccaccaactttccaacctaaaaatacgcctataattttcccaataaatcccattctttcccctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgcagaaagctcgccttttcctcgttccttacggtttagagcgatcaataccgccgcaagctctgccttatttgcactgattaattccatagattcacgaattgcagtgccagccgtaatcacgtcatccacaagcaaaatttttccttgcaatgggctaccaattaaattgccgccctctccgtgatctttcacttctttgcgattaaaacacacggtttatcaataccataacgattaaataacgccaccgaaactgaagtgccaattgggatgcccttgttagcagggcccaaaaccacatcaanatctaccgcacttgcttgaattgccgcagcatagaactcgccta

SEQ ID NO: 126 - DNA, 1254 bp, H. influenzae
cgatattttacaatatcttcagcaataaaatgaccaccactttttactcttgccttaatccgtgcaagatttatttcaatgcgattaataccaatataatttaaatgtacatagaaaccattttctttagcgttctttattctctgaataattgaattgcccgaaagcgttgattccatagaaaaatcaatatgtagcttaatagcaaaacgaaatagccctatcgcttttctgcctgcatcaatatcagcaagtcttggattttgaggattaatctgcattgcaatatgatcagaatcaatcacaatttgcacagcatcttggttaaaagaacgtaaagtactttttcccgaaccatttttccacaataaaaaatcgctttattttgcataacccacaattttttccgaaccatccagataatgctcgactatcttgccatcagttttttgaaagataaccacctcgtgattcattttctctttcatccaaactgaaaataacgctttaagttgtttctgttgttgaataattttctcacgttcagtcatcaattatcctctttaattaattcaaaacctactgctcaatactcaaaattgaaagcgttgataaaaggcaatatcgttcatttattaacccacgttttcagtagaaagattccaaccttgcagacgtaattgtttataacgttctcgagcttgtgtttttaacgcatcatctttcggcacaaaatcaataatttgggtaaaactatggctaaaatctgggatttcttgttgcaaattgattaacaaatcgcggtgttgtaaatttcgttttccaagccacgaaatctcaatcggtgtgggatattgtgttgcctcacctgataaattatgcggaacaaattcattgggatctcgttgccacaaaagttcatcaatttctaatgcttggctctcactttcgcaactaattagtacttttttccctgaacgccatattgaagcagcaagattacaggctatttcttcgacagttaaagtacaattttccgtaagaatataaaattgtgcagtttttgccattttagccccgttattttctcaatcttgccccatataaaactgaggattttaacgaaaaaaccttagaagataaatacttaaatagatattattaaaaataattcattgtaattgattagataacagggtggtttgatgcggatagacatcaaagcacagcgagtatcttttccgccaatggaaa

SEQ ID NO: 127 - DNA, 1341 bp, H. influenzae
  misc_feature (1304)..(1304): n = a, c, g, or t
cgcaaaacacaaagaggccttaagcctcatatactttatgcaacaggtacaacagggcatattttagaacgagaaacaggtttaagcattcaatctttattaagtggtccgatgggaggtgaccaacaacttggtggattaatcgcagaaaagaaaatcgacatgatgatcttcttttgggatccaatgaatgctgcaccacatgatcctgatgtgaaagcccttatgcgtattgcaacagtgtggaatatccctgttgcgattaatcaaagctctgcagattttcttttaacttcagttttatttgaacaagatgtggaaattgacgtaccagattatgaagggtatttaaaagagcggttagcttaaactgcaacgaaaatttaccgcactttatagttgtagggtgggctttagcccaccaattaaccataaaaaatagaataaaaacggtgggctgaagcccaccctacgatacttttaattaaatacaaaacagggcgacaatttatcgccctgtttcagttatctcccaaatccccccattacaagtataaagagtaccactttcaactgttcttctgggattggcttgccgtttagtttcaagtcgttattttctagagcaagcgttaatgttacggttttgtccgtgtttacgataatgtcattcacttcaccttcggtaactaattcattcaatcggcgaacgaaatcttgcttttggttttctggtacaaatttagataacaatgaaatcgcagtttctttgttcacatcaaaattgattgaaaaatctttgaattgtttgtataagccactgcgcattaaatcaaatttaggatttggcactaaagcaatatttagatccaatgccactttgcctttttcatcagaaatagacagaggggtacaattaatttgaggctgattattcgcaatgatcaggcctgcttggtgaaacttttgcacccaggttctacattaaagcatatctgaggtcgcttctgccattggcaacaaaattattgaaagtttctcggactcgcgcggccatcagttcggttgaattcaactttgcggggcactttccctacgggtggaccggtggttagattgaatcccaaattcgctttacgccgcaatcgccctggctcccctctacttggtattttatattgttggtgtattttctcctgactagatattctcggtccgtcccgcccgatgttttttggattgttttactctttttcaccctccgttgtttctcttacgctcagtgcccccttcgtctcgtccgntggtgccgttgcggacagccccttgttgcttcccgac

SEQ ID NO: 128 - DNA, 1204 bp, H. influenzae
  misc_feature (1086)..(1086): n = a, c, g, or t
  misc_feature (1139)..(1139): n = a, c, g, or t
aacgatttgactgcctttatacgcatagagtgcaagcgaaccgccaattaccacaacgaggtaagccaaaatatacaaaccacgagttggatccgatgcaaatgcgtgaactgaaactaagataccagaacgaactaagaaggtgccgagcagacaaagtgaaaaggctaaaatcgcaagtaataccgtccaagctttgaaagaacctcgtttttctgtcacagaaagagagtgaatcaatgcagtaccagcaagccacggcataaacgatgagttttctactggatcccagaaccaccagcccccccagccaagctcataataagcccaccaagaacctagtacgatacctaaagttaaaaacacccaagcagcaagcgtccaaggacgtgaccaacgcgcccaagctgaatctaattttccagtcattaaggatgctatcgcaaacgcaaatgccaccgaaaaacccacatagcccatataaagtaatggagggtggaaaatcaagcctacatcttgcaacattggattaagttcttttccatctactgggaaatcagggaaagtacgcgtgaaaggatttgaggtaaacaagacgaacaatacaaaaccgacgctaataatccccataataccaagcacgcgagcaaccgcttcttggggtaaatgtttactcaataaagcaacggcaaatgaccaaaccgccagtaaccaaatccacagtaacaaagagccttcatgggaaccccataccgcagataaacgataataaatgggtaaagtagtattagaattatttacaatatattgcacgctaaaatcattgactgcgaataaataaaatagcgcagcaaaagcaatgcttaggcttgcaaataaaccataagtcattgggcgagctaatgccattaattgtacattgcccttttccgccccccacaaagggaaaatcgccaacataagcgatacagctaaacttaaagccagcacataatttcctaattcagcaatcattttgcgccttctttttcttgacgatcacgctcactttcgccttttaaatctgctgccttaatccccattggnttatgtactttttgcattttttcgcctaattctgcggcacataatttcatcgngtttagcaatacttctgtcgcgcttaaaccgctgactgaggtatacgccttgagccaccatcccg

SEQ ID NO: 129 - DNA, 982 bp, H. influenzae
ttttggcccagacttggcatgccctgcaggtcgactcttagggaatccccattttatattgaataccaacagcatctaataatgaacataattgttcaaaatgcgcacggctttcatcatctaaataatcaagtaatttaggcgcgttatctaatactttttgtaattctggattttttgtatccaaaatacgaagcggatttcttactaaacgctctttttcttcatcgctcattaaatcttgatggttttctaagaatccaactaaagctgaacgataatttgctcgagcttctaaagaaccaattgagttaagttgaagtgtaacatgttgatcgatacctaacgctttccataaacgataggtaagcatgattaattcggcatcgatttctggattcgcaataccgaatacctcaacacctacttgatggaattgacggtaacgccctttttgtggacgttcgtgacggaacattggcccgatataccataagcgttgttcattattatagatccaaccgtgttcaatggctgctcgcacacaacctgctgtgccttcagggcgtaaggttaattgttcatcgttatcccaaaaggtgtacatttcttttgagacaacatcagttacttcgccgattgcacgcgcaaacaatggcgtactttctacaattggcatacgcacttccgaatagccataactatttaatacattgcgtacttgtgcttcaatccattgccataatggagattctgttggggcgcaatcgttcataccacgaattgcttgaattgtttttgccacgcgctttcctttaataattctggtttttggaccctggcgtgcgactttcgcacgaattttcgcttctaatgggtaactatactttcggtaacaaacgcttttttttgggtttgtgccccagataatacccgttttttttgttaccgccgttccccctaacaccgcccacatgccctc

SEQ ID NO: 130 - DNA, 1715 bp, H. influenzae
caagaggaatgcgagactacgtggagtgaataaaagaccagagcagtaaatacgaagagaggtcccctgggagcgccggcgcgacccgcgggagagaagggaaggccaacggcgcggcggaacacagacccaaaacaggcaagaatcgaatcaaacaacaaacgaaaagaacgaacgcaaagataatgaaccaataacaatgattcagaaccacaaagagagaagcgcgcgcgacaagacacaacagaaactgaaacagataaaaaggaacaacaaaccaaaagaaggaccaaaaggagcgccccagagccccgagagggcagcgcgccccgcaagagcacacaccgtcccagcaagactccgaagcgcgcagacaagaagtcaatgaatagaagcacagcaagcggacaggatgttcccgcatatactcacctggccacaaaattaatcgcgaatcgagcgcctgaacggtagaggtcggcagaatcacaagcgtagtttataatcactggcaagaagtaaagggcttccccgatatcaacaaccgccctacccatttgctatttaatatggcaacaggtgcaggcaaaacgatgatgatggcagcgttgattttgtattattttgaaaaagggtatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgctgacgtgcaacaaaagtacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaatatcaaaaaccaatgtgattattaccaactccgagagcaacaaaaccaaaccgaaaaaccgacagcgaaaccgaaaattgctaaataatttggaaagcggcgataatccgaccgggcatttttacgggggaagataaccgaggtgtggacgtctgaa

SEQ ID NO: 131 - DNA, 1394 bp, H. influenzae
aataaatttatttaataatctcaatcacttctctgactaatcgtccaatttcatcccaatttttggattgaatcaattttttctccacaaaccaagagcctccacaagcaacaatattaggaatagcaagataatcccttatgttatgaagccctataccaccagtcggcattatctgtaattgagcataaggaccgagcaatgctttaatcattttcactccgcctgaagcctctgcagggaaaaattttaccgccgaaattcccatttctaatgcaatttcaattgccataggattattcacccctggtgttattggaaaatttaaatcttgacataatttcacaatttttggattaaatcctggtgttaccacaaaatccgccccactacttttagctaaaactacttgttccgcagttaaaactgtaccggcagcaattaaaaagtcaggtctatttgcacgcaacaaacggatcgcatctgccgctgcttcagagcgaaaagtaatctctgccacaggtaaaccatttttagccaacgtatctgctagcggcaaaatatcgtctgcattatccaacgcaattacaggcacaattttgagttcacgaagtttttcaataatttgttgagttgtgtatgacataattttccctatttaaaataattttttgcattgttgaaacaaatatcttcaatcattttacccagtaatgaaatgtcatttggagcttcacctttttcaacccatccaccaatcatttcacacaaaatacggcggaaatactcatggcgagtgtaagataaaaaactacgtgaatcagttagcattccaacaaattgactgagtaaccctaattgagaaagctgttgtaactgacgttccattccgtctttttgatcgttaaaccaccatccagaaccaaactgtattttccctgcaataccatcgccttgaaagtttccgatcatactagcgatcatttcattatctcgaggatttaagcaatataaaatagttttaggcagttgattttccttatccattgcatctaacaaacgagagaggggatatgcataagttcgatcaccaatggaatcaaagccactatctgcaccgagtaaagcaaacattcgactattattgttacgtattgcaccaatatgcatttgcattacccagtgacgtttacaatattccgaagccaaccagactaaaattgcagtactaaattgagcaacttcttcttccaagagcggttgattttgcaaacgtttttgtaaaatactattcaatactgattcatctggaatagctgaaaaacggacaatttccataccatgatcagcagatttacaacctgagcagggtaccgagtccgaattcgaaacca

SEQ ID NO: 132 - DNA, 1477 bp, H. influenzae
  misc_feature (1308)..(1308): n = a, c, g, or t
atgctttgtagggtttctttacctaaatgagtacgataaaatttgcagaatctacgccattttctgtttccttttcccattgctgtaaacgtaagttaagtaatcgagtggtaatttgctgaattaattcttgtttatagctcgctaatgtattggtttcaattgtattttcaaaaaaacttaattcaatacttggaattgttgtgccttgttcagaaatagaatctaatcgccatttgttgataagaggaatattaaaatcaattttttccaatgttgttttagtaattgggttttcttgggataggttttgttttaatagttttactacttgttttgtatcaatatcgcctacaataattactgacatattatctggtcgataccatttgtggtaaaaatcagcgacgcgtttagctgaaattgttttaataatatccatatctccaataggatcacgtaatacataacgagaacccgccatttcaatagcacttttcttattgccaatacgtaacattgggcttaaacgtcttcgccattcttcttgtactacaccacgttcgccatccacatctttaggcaaaaaagtaatattattcatccattcattgataacatcaaaagccaattctaatttttgctgattattgctatctaaatttaaagtatagactgtattttcaaaatcggtaaaagcattaatatctcgtgcaaacttcattccaagtttttctaacgcattaataatttgattttctggatatttctttgagccattaaatgccatatgttcaactaaatgggcaatgcctttttgatcatcatcttcgtgcattgagcctgcattaattactaatcgaatataaacgcgttctttgggttcagtattttttaatacaaagtattgcaaaccgtttgatagtttaccgtgctgaatatttggatcaaaaggtaaatcattattgggcgatagttccaatgattgacaagcaattagtgaaaagataagtaaaaaaagtgcggttgtttttttcattatttttacctagaaaaaagaaaactctacgctaagtaaaactagcgtagagtagggctggtggacatttcaaaaacccataagccctatacattgaagaaaattagaattgatagccaacttctagccaaaattcacgcccaggcgtatagacaccatattcatcgctggtagaaatagcagtagcgactttatttttacgtgttttattaagtacatttaaaatatctacttgcaaataaacgctatgcttacctctaatggttggntgccaacgaatgctgctatcccattgtgtggtgtctgccatagtgatagctacgatagcgtggaatggcatcatcgttatcgctggtaatcaaatcataacaacgaattggggctttcataacactttatttgaccaagaatatcgtaattggggatcgcatatcaaaa

SEQ ID NO: 133 - DNA, 1707 bp, H. influenzae
  misc_feature (1594)..(1594): n = a, c, g, or t
tgatggattttgtgaatcgcattgatgtgcgataatttagccgtttagacggctaaaatttcttgacaagctaatcgacttactgatagtttaaacgccattctgattattacgataggttttcaatgtctgtgcaaaatgtagtgctttttgacacacagcctttaactctgatgcttggcggcaaactttcccatattaatgtcgcgtatcaaacttatggcacactcaatgccgaaaaaaataatgcggtattaatttgccatgctttgactggcgatgctgagccttatttcgatgatggtcgagatggctggtggcagaattttatgggagcaggtttagcattggatacggatcgttatttttttattagctcgaacgtattaggtgggtgtaagggaacaactgggccttcatcaattaatccgcaaacgggtaaaccttatggcagccaatttcctaatattgttgtgcaagatattgttaaagtacaaaaagccttgcttgaacatcttggtattagccatttaaaagccattattggtggatcttttggcggtatgcaagcgaatcaatgggcgattgattatcctgattttatggataatatcgtgaatctttgctcatccatttattttagtgctgaagccataggctttaaccatgttatgcgtcaagcggtaattaatgatcccaattttaacggcggcgattattatgaggggacaccgccagatcaagggttatctattgcgcgtatgctaggtatgctgacttaccgcaccgatttacaactagccaaagcctttgggcgtgctacaaaatcagatggcagcttttggggcgattactttcaagtggaatcctatctttcttaccaaggcaaaaaattcttagaacgttttgatgccaatagttatttgcatttgttacgtgcgttggatatgtatgatccaagtttggggtatgagaatgtcaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaattaattagtcataaaaaagtgcggtgaaatttcaccgcacttcttcttttataaccagttattcttcagaactgctttcttccaaagaatcttcttcatctgcatcacaaacacgttctaaacttactacgtgttcatcatcggcagtacgaattaagcgaacaccttgcgtgttacgccctacaatgctcacttcgcttacgcgtgtgcgaacaagcgttcctgcatcagtgatcaacataatttgggtctgtttcttctacttgagttgcagcaacgactttaccattgcgttcactcactttaatcgaaatcacaccttttgtattacgtgatttagttgggtattcacttaattgtgtgcggttttccgtagccgttttgtggtgctggtanaaattcccctttaccttttgcacaacgagagaaccactttatcgatatttagcctatgatgctttagcggtgtatcaaaatatcttcaattctaccgcctttctcgtcagaat

SEQ ID NO: 134 - DNA, 1411 bp, H. influenzae
  misc_feature (1094)..(1094): n = a, c, g, or t
gagaccccctccacgttgatgtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaataattaacaagaaattgttttttgaataatctgaaataacttaaattttaaccgcacttctcaaatagcgtcgtgaagtgcggttttattttggggttttggcaaaaagcctttttataaatttcaaaaatatgcaaaaatagggcgatttagtttttattttattatgggtaacaaggattctttttaatgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttgnggcggacctccaggctcaccagaagaagatggcgaccgttatattgaaatctggaacgttgtgtttatgcagttcaaccgtttagcagatggcacaatggaaaaattaccttgtccgtctgttgataccaggatggggattagagcggtatttcggtgtggtgcaacatgtgaacttccactacgagattggttttttccaaacattaatccccaaaacgggggaaattggagggccacagattcaactacaaatcactccggttatgctggcctatccgcctttggcatataacgccgatgggttctcccacaaag

SEQ ID NO: 135 - DNA, 2349 bp, H. influenzae
  misc_feature (553)..(553): n = a, c, g, or t
  misc_feature (2238)..(2238): n = a, c, g, or t
ccgaaaaagtttgcagtcaatcgtgattattatttaatatggcctatgcaaaagcacaaattttttaaaccggatgttcagctaaatgatgaaaaaacaaaagtttaatgtaaccattgatgtaaatgaaggtttacagtatgactttcgtagtgcacgcattataggtaatctgggaggtatgtctgccgagcttgaacctttactttcagcattacatttaaatgatactttccgccgtagtgatattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaatngatcctatcaatggtagcaatgatgaagtggatgtcgtatataaagtcaaagaacgtaacacgggtagtatcaactttggtattggttacggtacagagagtggtattagttatcaagcaagtgttaaacaagataatttcttaggaacaggggctgcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaatacctcctattatgtaggattaggccatacctataataaaattagtaactttgctctagaatatacccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagatgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgccgctcaaaatggtaatagtaatagtaatagtaatggtacttttaataagataagttctgatgtgattggtggtaatgcaatcacaactgcgagtgcagaacttattgtaccaacaccgtttgtgagcgataagagccaaaatacggtccgaacttccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttctaataaattgaacttttttcttcatcagaactcaaaaacaacgttctctgcctaatttaattgggcagagaaaatattaaacccatcatttaattaaggatatttatcaaatgaaaaacatcgcaaaagtaaccgcacttgctttaggtattgcacttgcttcaggctatgcttccgctgaagaaaaaattgctttcattaatgcaggttatatttttcaacatcacccagatcgccaagcagtagcagataaacttgatgctgaatttaaacctgtagctgagaaattagcagcaagcaaaaaagaagttgatgataaaattgctgctgctcgtaaaaaagtagaagcaaaagttgcggctttagaaaaagatgcacctcgcttacgtcaagctgatattcaaaaaccgccacagggaattaataaattagggtgcggctgaagatgcctgattacaaaaactaatgcaggaacaagatanaaagtttcagattccaagctcaaaatgaaaacgtccagcctgaaaacgtgggaaatattaaaatgcattcaaactgcacaataatttagcaaagcaaaggtttttttatgt

SEQ ID NO: 136 - DNA, 2007 bp, H. influenzae
  misc_feature (1996)..(1996): n = a, c, g, or t
ctagggggatccccaaccaaaaccaatcatagcttgcccttgaactgacattaccgttcttacatcagcgaagtccacgttaattaaaccaggagaggtaatcatatctgaaattcccattacagaattacgcaatacgtcgtttgcagcagcaaaagcatcaattaatttagcatttttagggagaactttttggatttgttgattcggaataataatcattgaatcaacatattgggataaatctttaataccaagctctgcaaattgcatacgttttttgccttcaaaggcaaaaggtttagtcactacagcaacagtcaaaatacccagttctttagcaattttagcaacaacaggtgccgcacccgtacctgtgccgccacccatacctgctgcaataaagaccatatcggcaccttcaagcattttacggatttcatcctgatcatcttcagctgccttacgaccaatattcggatttgccccagcacctaaacctttggttgtttctccaccaatttgtacggtctgttgaacttgacttttacgcaatgcttgagcatcagtattgacggcataaaatactatgcgaccgtgttcctctgatgttaatgaactttcgccaacaaaggttccgcccatttcttgttttaccatattcattaccatatggtttacggcattgccaccgccaccgcctacacctacgactttgatcagtgcgccggattcgttaaaattatcgtactcagggtactctgggtatagcattgatgttctccgttactgccagataagctgactaaatatataaaatataaattccctttattgtagatgaaaaattaaaataatcaaaattctgaccgcactttattgacaattttttttactccttgccaaatagattcaaagaaagttccttcagaatcatcacttcctgaaattaaatcatcatcactattactgtgattatattgcaataatcccaccaccgttgaatattgtggacgattcacgtaatcagtcaaaccagtaatatttaatggactcgcaatacgcacctgacaatggaaaacatttgaagcacattctttaagatcttcaatctgcgctccaccaccagttattaccacacctgcaattaattcaaatttaatatgttttgcttctaattcagcttttaacttatctaattcatcttttaccacgcctaaaagctccgtataacgagctgatgtaattaaagataaatcactttttgttaatgaacgaggcgcacgaccgccaatacttgccacctcaatttttttatctccgtgcaaacgagctgggtaaaatgcactagcatagttcactttgatccgttctgcttctgctcgcgaaattgtacaagcgtgcgcaatatcatttgtcacaatatttcctgcgtaaggaattaccttgctaaaacgtaatgcgccattcgtataaaccatcacgttcattgtgccagcaccaaaatcaattaaacacacgccgagatctttttcatcctcagttagcacagaatgtgttgctgcaaaaccagagaaaaccactttatccacttgcaatccacaacgttcaacggctttttttaagttattttgccaatcttgatgacaagcgatcaaatgtacttgtgcttttaaacgcacgccttgtaatcccaatggatttttaatgttcatctgacgatcaacagcgtattcttgtggaataacatgcaataaagataagccttctggcaattttattgagcttgctgtatgaagtgcggaatcgatttcctcttgtgttacttcactttctgctatcggcacaaaaccactttcattgaggctttgaatatgctctccagtatagctaaagtcacactcataatctgacaatcaggcatagattctgccgcttcatagcacgttgaatcgaaccacctacgcatcaagatagtgatgctgccacgatcatnccttttgaaga

SEQ ID NO: 137 - DNA, 1529 bp, H. influenzae
  misc_feature (1335)..(1335): n = a, c, g, or t
cggcaattttatctaggtatcttccatattcgcggtgaaatcgtaattcattaattcgccaaaagactcattgaggcgatcagtcacaatttcgcccatcttttctgcatagaaacgacgattttcagtgcgaacataaccacgttcttgaatagtggaaataattgccgcataagtggaaggtctgccaataccacgtttttccaattcttttactaaagccgcttcagtaaaacgagcaggtggtttggtaaagtgttgtgttggttgcacttcttttaaagcaagtttttctgacacagtaactgaaggcaattcttgatcttcaggatttttacctatctgtggcaatacttttgtccaaccatcaaaacgtaaaattctgccttttgctttcaaggtataatcgcctgcggaaacggtcagcgtgctactatcatattgtgcaggtggcatttgacatgctaaaaattgacgccaaattaaatcataaaggcgcaccgcatctttttccattccctctaaggattcaggcaatgctcgaatatccgatggacgaatagcctcatgtgcctcttgtgcattttctttactagaataaaaatttggtttttctggtaaatattgtgcaccaaaatgattttcaatatagctacgcgccatattcagcgcatcttgactcaaattggttgaatccgtacgcatataagtaatgtaacccgcttcatataaacgttgggctaacatcattgtcttcttaacgccaaatcccaagcgagtacttgccgtttgttgaagtgttgatgtaataaatggtgctcgagggcgagaacttgttggcttagtttccaaatctgtgacaacgtaatctgaaacattcagaaaatctaccgcactttgtgcttctttttgattttttggatcaaatttcttgcctttataatccgtaacatccaagcgtatagcttgtttattttgattattcgtaaggacggcaacttcccaatattcttcaggctggaacgctttaatttcacgctcgcgttcgactaataatttaaccgcaaccgattgaactcgaccagcagaaagcccgcgtgccacttttttccaaagtaatggtgacaccataaagcccactactctatctaaaaaacgacgagtttgttgggcattaactcgatccatatttaattgttcaggcttttcaaaagcctgtttaatggcatttttagtgatttcgttaaacaccacgcgactaaaacgatcattgttaccaccaatcacttcacgtaaatgccatgcaatcgcttccccttctctatccaagtcggntgcgagataaatgtgatctgcttttttagcaagcgactttaactcggaaaccactttttctttacaggcaaatctgataattgctttccaatcgtgaataaggacatccccatcgtttactaaggcgtacgttcctttttgcctaatttttgcttttcttcgcatcatacttttgtggaatggttaacctttcc

SEQ ID NO: 138 - DNA, 1083 bp, H. influenzae
  misc_feature (1055)..(1055): n = a, c, g, or t
gttttcgaatatcgactcggtacccatgccgtgatatctaaatgctccgtgctgatatggcgacccgagcgcaatagactatctaccgctggaatattggatttgcaatcgccacagcgagttttggggaaattacatcttgaaggttgtctgtcataggttatttctcaatatctaatgctttattgtattcacattcatgaaaaaagtgattgaaatctactatatcggttgcaggaaattctaaacttatttcatttctgatatgttctaatatcttgcttcccactaaatatgcagatttcccgcgcaatgctttatcgtaccattttattagatctgcctcagtgataatactctgaatcttagaacgccaaccaatttgatttaataaagacaaaataagtttttcttcactctctttacatacaataactattcggtcagatgaaactgaagatacaatgttttcagctaattcttcagttaatgataaatgttttatttgaattgccataccaaaattagcccacatatccaaaccccgatctgaagcatttgttacaccaactctattaatttttgcattaagttccaaactagtattctcactatcaagagaaataatttgacgagtaaaatcttcaaactcctttaacaaatcaatattcgataaatctaaatcaatttttactttaacgcctaaagcctctattaaagatgaaaacaacgcataaacaactatttcataaactttatcaatacttcgttttaaaccgggttctaaccaaaaaagagcaagaaattcacttagatgaaaattatctggagtacgagaataactatactctaaggctgatgacatctgattaaagcgttcaaaaaactttttataaatataactttctactccaccatttgtttttctattcatttctcctaatatatttaaatgtttgggaggcatagcgttatcattaaataaatcgtcttgatatttagctgacgatgttgatactcttcctaaaaaacggatacaaataacaggggtctcntagagtcgaccgcaggcagcaagctggc

SEQ ID NO: 139 - DNA, 1163 bp, H. influenzae
  misc_feature (882)..(882): n = a, c, g, or t
atatccatacgtcccacggctttcttgtggtggtgtttctgtttcagttgttggcgtgagagagggagatgatgtttcgccacagaaattctgaccattatttagccaaacaggaattgttcgataactctcacaatcccagtcaccgtattgatttatccccacccatttcactgttgtagggggagtaattgctaatttttcaatatttgtacggtttaaataatctttataaatttgcaatgcgccagaagcaccagtcagttttgtttcgccattatcatcgcgaccaagccagacggtgctgatattttttccgtcaattcccacaaaccacgtatcgcgtgattcattggttgtgcctgttttgcctgctaaatgtaaatcagcgtaatccttttgcaaactgcgagctgtaccacgttcaacagtttgttgcattgcaaataaggtttggaatgccgcttcttgtggcaccacttgttttgcacttttatcgtgttgaaaaattaggttaccttgacgatctgcaatactatcgacggttgtaagcgcaattctcccaccttgattggcaagggtttgataaagttttgtgacatcataaggcgaaatgctataagaaccgagcaacatcgcaggcactttaggaatttccacgttgtcccagcccatcgctttttgcgtgtcaatgactttgctcaagccaactttcataccaatatttacagtgggaatatttaaagaacgggctaaggcatccattaacattactgaatcactatattttttgtcatagttgcgtggctgccacggcgggctacctttgacattaattgttattggttgggttataattggggggatatcaaacgggaactngttctgggttagaaaggtgcgggcaaataataaaaaggttttactaaagaaccaatctgacgttttgccattaatgcacgattaaagcctgcataattgcgtttgtaaaccgccaactactgcacgaatttcgcctgtgcgataatccgttataatcatcgctcctctatgggggggattttcattttcagttggaattgcaaaacggttttgaccattgcattttctgcttgacctggggggttaaaaaccattggggaaaaaatactccgccagtaaaa

SEQ ID NO: 140 - DNA, 1005 bp, H. influenzae
caacaacctataattaggtgctgtaaattgcaccttttttataaaatcatataccgtgcaaaattgcaccctactcgaagcattagataatgaaaaacgaaattgatattaaaaaactccgtaacatcgccattattgcgcacgtagaccatggtaaaaccactcttgtagataaacttcttcaacaatctggtacttttgaatctgctcgtggtgatgtggatgaacgagttatggactcaaacgatcttgaaaaagaacgtggcattaccattcttgcaaaaaataccgcgattaactggaatgactaccgcattaacatcgtagatactccagggcacgcagacttcggtggcgaagttgaacgtgtactttctatggtggattctgttctattagttgttgatgcgtttgatggcccaatgccacaaacgcgtttcgtgacacaaaaagcattcgctcatggtttaaaacctattgtcgtaattaataaagttgatcgccctggtgcgcgtccagactgggttgtggatcaagtatttgacttatttgtcaatcttggtgcaagcgatgaacaattagacttcccaattatctatgcttcagcgctaaatggtgttgcaggtcttgaacacgaagatttagcggaagatatgacgccattatttgaagccattgtgaaatatgtagaatcgcccaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaaagagacgttgcctatgcttgcgatattgttgctatcactggttcaggagaattaatatttctgataccatttgtgatatcaacgcagttgaagcactgtcattttt

SEQ ID NO: 141 - DNA, 938 bp, H. influenzae
tgttttcgaatatcagactcggtacccgtcttggttacgatggccgtaaaaactctgacgtttttgcccgtgacaccgctgaaatatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttgggctgtttcttagggtggtatttggcaaaacaatatcaaggcaaacaaggtacattggcttgctcacttgtttcttccccagctcttgctgaaattgcgaaaaaatacgggttccaatcagaagaaaccttaactgggttcaaatacattggtaaagtatctggcttattggtcggttttgaagaggcatgggctatctagtggacccagaca

SEQ ID NO: 142 - DNA, 1323 bp, H. influenzae
  misc_feature (1024)..(1024): n = a, c, g, or t
  misc_feature (1050)..(1050): n = a, c, g, or t
  misc_feature (1104)..(1104): n = a, c, g, or t
  misc_feature (1163)..(1163): n = a, c, g, or t
  misc_feature (1250)..(1250): n = a, c, g, or t
  misc_feature (1259)..(1259): n = a, c, g, or t
  misc_feature (1264)..(1264): n = a, c, g, or t
  misc_feature (1267)..(1268): n = a, c, g, or t
  misc_feature (1303)..(1304): n = a, c, g, or t
  misc_feature (1311)..(1311): n = a, c, g, or t
  misc_feature (1318)..(1318): n = a, c, g, or t
tttttctggttctggctctttttgacattttctggctcaggctctggctctttttgtacatcttctggctctggagcaggttcttccaacaccatgccctgtaatagttccatagaaatacttgtagatatatcgccttgtgcgctatttgcactatcacttggctcattccaattccataagataaatcctataataataccgtgtgcgatcaaagaaataagcaaacccaatagcgaacgttttgtttgctgcataattattccttacggcgtagttggtacagattgggaaggagtagattcttgagaattttcacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcaacataattacacttggatcaatgtcgccaccgccgtgaccgatttgatagaaagttaataaaatcccgataactgtaccaagtaatccaacataaggcgcatttgcaccgatggtagaatcactggcatattacgggttaaatcaatatctaatgcctgaatagnagaataatggggcccgcttacccttnctaaaaaaagatacggtccattaccctccgcagcctaataaggctcatcggaanaattaacccgtgataacataatcctggcctgtgggcaaatccaaagcgggccccttctntcccctgcattcgggacaatccttgagactaaccggcaggcagttctttctcgggggctcctgccgatccgccaacgcggaactttnagtatattnccganatnnacccacccaccgcccgtgttcgatctttcccccannctggccncgccacnacctg

SEQ ID NO: 143 - DNA, 1305 bp, H. influenzae
  misc_feature (1282)..(1282): n = a, c, g, or t
gagacccctggttgttgcttggagtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaataattacccaaaaaacgcatacaactgatttaacgtattttcatcggttgtatcgttaaaaatatgcttgattgctgcactaattaacgctttgtaacagctttcaaactctgcttgctccatattcccataactcaaggattgcgcctcaatccgcaaatcccctttaatgttgtatgtagattcgtaaaatcccgccaataccgttagatgtttacgaaaggtgtcaaattgcttgcgctcatcaaagtgttcccattctgttttatctgcagcccaatggttaaaacagaatttaaaaaaggcgaacaccttacgatggaaagcgggattgcgtgtacggatgatttcaatttcatactgctcgccattttttaatgatttcaattcttctgattccagttcatcaagtggcgcaagcacaccgccttgtaacttaatcatctgaatttttaaccgcccttcagttcgtttcccgtgtgcttttttaatatcatcaacactacaagccattaacctatttctccatgcggatatacccactaacctttttaataaaatcaaggctaattgaacgtgtgacaaagtcttccattgttggatcaaagactacgaccatttgccctttgctattccccttgatttcttttcctgttacagggttgataaatgcaattcgaccacctgtaatatcaatcacttcatttgccacgccttgaatatggttttgataccattgagtagatttatcattgttgagtaacatcacgactaaataaccagcatcacataattctttcgcacgttgtagatatggtgtaacgttggaataaggtggattcacatagattcttaacggagccgaacaacgttctgcgacttcatccaacaatacatctaacatttgctcaatcggcattagaaagtcatctgcgattgattgatgctcatcattatctgagttaggctcgccgatatagtgacatgtcagggcgttgttggctgtagcgcaaccatcaagatcgaaccacccgaaacgttgaagaagcccttcaaatacataacacgggtggttgccatgtatttttatatcaaatggtggncctgcatttgcatgcccccttta

SEQ ID NO: 144 - DNA, 1265 bp, H. influenzae
  misc_feature (1153)..(1153): n = a, c, g, or t
  misc_feature (1168)..(1169): n = a, c, g, or t
  misc_feature (1173)..(1173): n = a, c, g, or t
  misc_feature (1179)..(1180): n = a, c, g, or t
  misc_feature (1195)..(1196): n = a, c, g, or t
  misc_feature (1208)..(1209): n = a, c, g, or t
  misc_feature (1213)..(1213): n = a, c, g, or t
  misc_feature (1230)..(1230): n = a, c, g, or t
  misc_feature (1250)..(1250): n = a, c, g, or t
  misc_feature (1255)..(1255): n = a, c, g, or t
gaaatccccttcaaccccattaagcctgggtggcgaaattggtagacgcagcggattcaaaatccgccgttgaataaacgtgtcggttcgagtccgaccctaggcaccacatacaaacccttgatcgttggtcaggggtttttcttttatgcatttcaaccagtaaaatcaataagttacgttcatatccgctataaattcatcaccaatcccaacctcaaatattgccatttttaagtatttttatgcatcgattacgccaaaattacgccaatgcaacatgaaatggggtgcggaagaggaaaagaaaatagaattgcaagcgcaaggattgcaacctgatacattattttctatttgaacgaaattacgccaacaaagcgtggagaaaagcacgaatttaatcggctgaatcgctttttacgccatccagttacggataaatatatatctgatgttagtcggataggggatgaggaattgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgattagctaatatgtttagcattgatccgccccaacgaacaacttcgcctgcgatatagcgtgggcgagaattttgttgatcgactgtaacgggttttgggaaattaggcagttttgaaataatcttggcaacggtttgatagtgtcgcccaaaatatattgcgatatcctcaagcgtaattaaattttggcttttctcggtcaaattagataacgccgccatttttgccgcattcacaatttcttcttcggctttctgcgaaagtttaattggttccatatttcctccaataaaaaaccgcccataagagcggtggtttgttaatattgttgtgtctgttcggcatgacagattttgccgtcacagtcttgattaagatttagggcgtgcgccatatacaccacaaatgcacacacgagcgtaatgattaatttgttcattttnctgttccattttgtnncggnattttnnagagtgtgaagaatnnccgccgcatggnncttnaaaaaaaagtgcgggtncgggggtaaccgagatctgnaattncggataacat

SEQ ID NO: 145 - DNA, 1056 bp, H. influenzae
ggccagacttggctagccctgcaggtcgactcttaggggatcccccatctaccacgataaatccttcgccgccatttggcacttgggctgcatgaagaacttgtagttcaccttgattgttatgatcgtgataacttgcgatacaaacggtttcaatatgacgaagacccaattctctagccaatacagccgctggaaacaaaccaccgcgactcaccgcaataatacctttccattgggaagctggaagtaaacgttctgataatctgcgggcatgcatttgaaacatatcccaagttaccacatatttttcgctcataattgcaccttagtttaaatttatcgagaaataaaaaattgcgtaaggataacccgaaatggcgttttatgctattatttcgtaaatattttcagtaaaaaggagcaactatgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtggggaatattctcattcgtaaacccgcgacgaaaggaatggaaaatcacacgcctgttgtgctacaagcccatctagatatggtgccacaggctaatgaaggcaatccacatgattttaccaaagatccaattcaaccttatattgatggagaatgggtgaaagcacgaggtaccacattaggagctgacaatggtatcggtttagcctctactttagcggtgttagaaagcaatgatttagcccatccacctcttgaagtgcttttaacaatgacagaagaaacaggcatggatggcgcaaaaggcttacgtcatagctggttacaatctgaaattttaatcaatacagataccgaagaaattggcgaaatttacattgggttgtgcgggcgggattaacgcaaactttgaaattcccgttcaatatgaaaccaatacgtttgagcgcagcgcacaaatcacccttaaggg

SEQ ID NO: 146 - DNA, 1742 bp, H. influenzae
  misc_feature (1645)..(1646): n = a, c, g, or t
  misc_feature (1648)..(1648): n = a, c, g, or t
  misc_feature (1652)..(1653): n = a, c, g, or t
  misc_feature (1655)..(1655): n = a, c, g, or t
  misc_feature (1660)..(1660): n = a, c, g, or t
  misc_feature (1665)..(1665): n = a, c, g, or t
  misc_feature (1671)..(1671): n = a, c, g, or t
  misc_feature (1680)..(1680): n = a, c, g, or t
  misc_feature (1682)..(1686): n = a, c, g, or t
  misc_feature (1694)..(1699): n = a, c, g, or t
  misc_feature (1710)..(1710): n = a, c, g, or t
  misc_feature (1722)..(1722): n = a, c, g, or t
cgagacctcggtacccaatatatatgaaaagtacttgattacaggattattggttttagctggcacagcacaagctcatgaagtttgggttcaagcaccgacgaaattaacatctggttctgtattaaaagcagaattagcttatggggattacccttatgtagaaaaaattcctgaagcacgtttaaaaatttttgcaccaatggaaattattcgtcaagatggagaaaaacaaaccttaatccaaaaaggcgaaaactatcaatatcaatcagagaaagcattgtccgatggttcttattgggtaacagcgacttataaacctactttttggtcacaaaatgctgaaggttggaaaatggataatttgaaagaattagaaaatcccacttattgtgaacaaactcaaatgtttggcaaaagtcttgttaccgttggtaaaaaaccattaaatgcagaaatggcaatgacaagagttggtttaccactggaaattgttcctttgcgtgatcctagcaaagcgaaatcaggcgaaccgttccctgttcaaattttctaccaagatcagccattagcaggcgaaactgtcatcgcaaccgctgatactattatcgtgaaagatcttgaagcaagtacaggtcatcgtgaaccaccaggtttttcaggtaaaacagatagtcaaggacgtgtgaatatcattccattaattgatggtattttggaaaattaaagttattcataaaacaccatttgcagatcaacaaatttgtcagcaatctgcaagctatagcacattaattttaccggttggtaaaggattagctaaactacctccaaaaccagaacaccatcatcactaattttaaaagtgcggtaaaatttcaccgcacttttacatcctaattaaataaaaaatacagaaatagtctgtctaaattctaagttattcatttgcatatccagattttggcagagctttcccatctagatatgccaaattatctttaagtcttaatcgcccttcggtaaaccatttaatcacaagcggataaatttgatattcttgctcacgggttttagcctccacttcttcgatgctatcttcagggaagattggcactttcgcctgtaagacaatcgcaccaccatctacttcttcattgacaaaatgaacggttgtaccgtgttcattgtcgcctgcttcaatcgcacgttggtaggtgtttaagcctgcgtatttaggaagaagagaaggatggatatttaaaattttccctgcaaaacgttgggtaaattttggggtaagaattttcatataaccagcaaggacgatcaaatctacggctaggctttgcaaataatcgccaatggcgtcgtccatttcgaggttattgggaaaatttttgcgaagaaagaccgcttgcggaatctgtgcttgtttggctcgaactaagccgtaagcatcagctttggtacttacccccaccagcaattttgggcggggaaatttgccttaatgggcaggctacaaaaaaagggttgggaaaatttggccctttgcccaaaaaaaagagacggcggaatttttttcacattttctccttcctaaaaaaaaaaaccccccacaggaggggggggggttttnncnaccnntntgccngccgngttttntttttttcncnnnnngttctttnnnnnnccccccccccngcctgtgcgccnccgcgccccccgcccccccg

SEQ ID NO: 147 - DNA, 1423 bp, H. influenzae
ttgcagagattggggtttggactcctgtgcggacatcaacaacaaccaatgccccttcccaaccagcaaaaaagcgagacccttcataagaaaaatccacgtgtcctggggtatcgataaaggttaaattataaagttcgccatcttgggcttaatattttaaagtcacacttgtgctttgatggtaatcccacgctcacgctcaagatccattgaatctagcacttgcgcttccatttcacgatccgaaagtccaccacaagtttgaatcaaacggtcagaaagtgtcgatttaccgtggtcaatatgggcaataatagaaaagttgcgaatattcttcataaaagatagtttttctcaaaaatcattaaatttaactggcggattgtacctgaaaagtgcggaaatcgctagagatgaaaaggaaaagtgcggtcaaattttcaaacttttagataaaacaaaaccccgaataacttcggggtttcttttttttcattcaaactgaaattataggctttcagtgaaagtacgagtgataacgtcgcgttgttgttctggtgttaaagagttgaaacgtactgcgtaaccagaaacacggatagttaattgtggatatttatctgggttatttaccgcatcttctaaagtttcacgacgtaatacgttcacgtttaaatgttggccaccttcaacttttacagttggtgctacgtttactggtaattcacggtattcgatttgacctaattcgctcactgcaacaacttggtcttcagcgaattcgccttttgcacataagcaacgcacttcatttttttcgctgtctaataaccagaatgaattaagcaaattgtcatttgccgcttgagtaatttgaatacctttaatcataatagcctcctaattggcacgaaaataataataaaactgtacaaattttatcaaatcattttaaaatctcaaattattttagatttatttgataaagagcaggttatttttttaattaatttttataaatttgatctaaattaaaatttattaatttttaaataaaacttatatcaataatttaacattaatttaactttttattgaatgagtgtttttgtttataatgaataaaaacttattaataggatagaataatgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacgggtgcaaaccaagcgcacggtttggctttttcagtaaaacctgaagtagccattcccccttcctattaaaatgtataac

SEQ ID NO: 148 - DNA, 1288 bp, H. influenzae
  misc_feature (1280)..(1280): n = a, c, g, or t
tgtatacgattcggactcggtacccctttggtagagtgggaaattctctaccttacaacccaataaaacctcgcgtaatgtgtcatttactggcactttacaagaaagccaagttgcgccccaatccagaaattgaacacgcatcccattttcattttgtagggttataagctgataaggtgcaccatcaggcgcattaaaagtggtttgttctaacatcattttctcttaaatcactcgcacaccttgtgatgcggtacacacataaaaagtttcttttaaaccagtcgttttctcgtaattatccgcaataattttacgaactgcatcgactttatcatgcggcgtaagtgcgacaatacagccaccaaaaccgccgcccgtcatacgtgcaccgccacttttgccaataacaagttgagccaattcaactaaataatcaatttgtggcacggtgatttcaaaatcatcacgcattgaatcgtgagatgcttccattagtttacctaaacaagtcaaatcattgttcttcaatgcttctaccgcatcaagtactcgttgattttctgttacgacatgacgagcacgttttgctgctaacggagaaagtgcggtcaattctgcttctcttttttggaattgctcaactgaaacatctcgtaatgctttcgcgccaaaaaattttactgcctcttcacattgctgacggcgagtattgtattcgcctgttactaaatcgtgcgggtacgtttgaattcacaataatcacggcgacatcttgtggcactggtgttgaaatagtttcaagactacgacaatcgatcatcagtaagtgattttcctgcccaagcgcagaaattaactgatccatattgccacatttatctttgtcaaattggttttcagccttttgcccattcaatgcaatatccgtgtgagagagcggtaaatcgccaagttgtcggcagaatttacccaccgcaacttctaacgctgcagaagaacttaatccagaagaaagcggcacattaccagaaatcactaaatttgcaccttgttgaaagtgcgggtaacgttcttggataaattttaccaccccacgcacataattagcccatttgtgttcactcttaggaatttcaacattgagagaaaattcatcagtttcatcaagagcgctagctaaacatccaaccagatctctcgttttgtaccagaaacggccgggggatcctataagagttgacgtgcagcgacagtcaagtctgtcaagcttcgtngctagcaa

SEQ ID NO: 149 - DNA, 1102 bp, H. influenzae
tgttatcgaatatcgactcggtaccctgtatattagcaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcaccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaatttttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaaccttggtgttgttcttccacatcaatagttacttgttcgtatggctcttgttttttaccatcaatatcacgatagattactttagggcgagaaacggcaagctcataaccttcacgacgcatattttcgattaacacggaaagatgtaattcgccacgaccagatacacggaattcatctgggtttggggtttcttctacgcgtaatgccacgttgtgaaccaattctttatttaaacgttcaagaatttgacgtgatgtgacatattgggtaccgagtcgatatcgtataaat

SEQ ID NO: 150 - DNA, 1152 bp, H. influenzae
  misc_feature (148)..(148): n = a, c, g, or t
acccctatgtggaaaagatgaaaatttaatcatctgaaatattaaacatcctaaatcgaaagaagattaccagcctgaagaaaccaaaattgagtattcaatttcaacaataaaaaccaatattgattggcttaatgatctattgtgngaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaaatcctttaacttttgaatagcaatcaaaatccctaattacattaaaaatgagagactatagattttgcacttcatctttattataatagtctttcaatgtaatactaaggagaaaaattatggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaatatcctcccccaaatatagaaacccttacagctattgatgaattatatagtggtaacgcacagagctcctttattgagctagtgaaaatattctgccgaaaaatctacaatccattcttaatgttggcaatatgccaaaaaaatcccttaaattagctttccaaaaattcgaagagataactgttt

SEQ ID NO: 151 - DNA, 1143 bp, H. influenzae
  misc_feature (1116)..(1116): n = a, c, g, or t
gagacccctagcgttcttcaatgctaaagcgagtttcagatggttttccttgctcgctgacacgcacaatacgctctccgctagataattcatttttcaaaagaggggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccacttccgccgtgcaccgcgattcctgagggtttatttaaaataatcaagcaatcatcttcaaacaaaatttggttttcaagtgcggcaactttattgagattttttgaaatcggcgcatcatttttttctgcgacacgcacaggtggaatgcgtacaacatcgcctgtttgcagtttatattctggtttaattctgcctttgtttactcgcacttcgcctttacgcacaatgcgataaattaaacttttaggtacgcctttgagttttgctaataaataattatcaattcgttgtccactttcatcttcactaattgtcagcatttttacggatgaattaatgattttttcattttgttttgtcattttttttccttttgaaaatcggtgcaaatcatatcataaaggcactataaacgtaatatgaacatcactctatgaacgcaaattcgccttgctaattaatcgttttctatggataatagaacgtctttttgcgcctaagaatttgcgtaaaaaaggataagttttgttggtaaaaactcaatgcagcactcggcataagacattgataatcaacatttttcttaaaataaattagccgcttgcaacgcgtgcggaatatcgcgttgttttatcaagcgaatatttatgcttaataacgttatcaatgcacccagcaacatacagtcgtgagattgactggcgcgagaaacacgaggtcgataatgaagcaaagtgcggtttattttgaggttttttaaattttataaggggtctcntagagtcgactgcaggcagcaagctgc

SEQ ID NO: 152 - DNA, 1526 bp, H. influenzae
  misc_feature (629)..(629): n = a, c, g, or t
tgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactatnttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgcccgaattactgggtgtgactgatcgcattttagtatgagtaccggtaattagcaggtatcgtgaaagcgcaaaacattcgcagaaaaaatttgcactcgcggcaaatatttataacctaggaatgaatttgagggccttaaaaaaacaatctttgtctttt

SEQ ID NO: 153 - DNA, 1648 bp, H. influenzae
gccagacttgctgcctgcagttcgactctatgaaatccccctgccacataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaggcaatctcacaatttcttctgacaaagtaaatatcaccaagcagataacaattaaagcaggcgttgatgagaaggattctagttcaagcacagcaagtgatgccaatctaaccattaaaaccaaagagttaaaattggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggcaacgtagaagtgacagccaaaacaggtgatattaaaggtgaagtcaaattcacttccggtaatgtaaatattacagcaaacggcgacacgcttaatgtatgtaatgctccaggcaatgctgttaccatcactgcagataatggcatattaaccacccaagatagctctacgattagcggaactgaaagtgtacccacctcagccatcaggcgatattggcggggcaatttctggtacacggtaagcgttaaagcaaccattgatttatttacccaagcaaattcaaaaattgagtcaaaacacgcgaaggctatgtatcagtgccacatgttaattggcggccaatctttgcaatactgaatgttacagcatatctggaagtatatatttagggggggcaaagttttg

SEQ ID NO: 154 - DNA, 1607 bp, H. influenzae
  misc_feature (1230)..(1230): n = a, c, g, or t
  misc_feature (1274)..(1274): n = a, c, g, or t
  misc_feature (1320)..(1321): n = a, c, g, or t
  misc_feature (1333)..(1333): n = a, c, g, or t
acctgaaacaattttaccgccttcatttacaatagagaccactgcagaaagagggccaattgcattggctacgtcattagaaccgtgcgcaaatgccatcgcacaagcggttaataacattaaaatactgaagactttttctacggcaccaaaagtgcctttgtttgctgattgagtgaagattttgcttttaaaatagaaatggaagaaaaacattccgataagactgatggcaagtgaaatgattaaagtttcactgtttgaaagatttaagcctacgtgttttaagccttttttcatcgtcacgatacaaagtacaaacacggttatccccatataataagggccatatttttgtgcattttttaatggctgttcagtatcaaaaataagtttttgcgtacttgcaaagattgcataagccaaaatacccgagatgacaggcgtgataaaccagctaccaacgatgctgccaatatttgaccaatctacagaactagggccaatcgtaatacaggcaaatccaataattgcaccaataatagtgtgtataccagaaactggccaacccattttggttacaataaataaccaagcacctgatgcaaataaggttgaaagcatacctaaggctaaaatatcgggtgtatcaacaaattgtattgggtcgattacgccactttttatggtttgtgttacttcgccaccagctaaatatgcacctgcagattcaaaaattaacgcaataataattgcttgtttggctgttacagtaccagatcctacggatgtacccattgagtttgagacatcatttgctccaattccgaacgccataaaaaagccaaaggctgctgtgatccacaccaaccaagaaccatattgactaataatttccatagttaatttcctatgttttgttgattatgaacgcgccagcattaattcaatgcgcgaaccgactcgttgtgcttggtcagccaaaacgccaacccattcaataattttatataagaacattacatcaattggattataacggctttcgatggtgtaaagcattttacgcaatttgatctgcatttggtctgtatcatcttcaattgaatcaagttcttgaatcatatcattgactaatttgagttcacgacctttaaaacccgtttctaatagcttatccatttcttcgattactcggtgggcttgatgaattgcatctaaactacgttntacgtaatgtaagatttcttcctgcatttcttcaggaataccanattgacgaccaatcatacggcctgcaatatctttggcataattggnncagttatcttgntgcgtgactaattctaaagatcagtacgatcgataggtaagaataaacacgtggcaatttaaccgattttcgcgtttaaactactgccccacgttcgcatgagaaatcttaacggttttctttcgcttgttcccaatctttagaaagcggttggaaaaaggatacaaagaacgttcattcggcacttttcaaaaaggtttttgtaccgcttgaaaggcgattggcaataaatccgagaattattcatgcctaaggggatactccaccttagggt

SEQ ID NO: 155 - DNA, 1358 bp, H. influenzae
agttaaaaaagacttggtttcggtttattattaaaacgctatacaaacaatgttgttgatgcgacagaagaacaaattaaacaagccgctcgtgatactattccaaatgtaggccctaatttttgggcatttcgtgcaatgattgcagctggtggtttaattgctttacttacattcggcgcatttgttcaaaatttacgtaataaagtcactcaaattccattattgttaaaagttcttttatggggcttgccattaccttggattgccattgagtgcggttggttcttagcagaatatggtcgtcagccttgggctatttacgagatcttacctgttggcgtatccgcttctaatttaagtacaggcgatttatggttctccattggtttaatttgtgcgctttatcttgcgttcattattgttgagatgtatttgatgtttaaatatgcgcgtttgggtccaagtgcgttaaaaaccggcaaatactactttgaacaatcagctaaataagtaggagataaattatgattgattatgaatttctacgttttatttggtgggtgttagttattgtattatttgattggcttctctgtaactgatggatttgatatgggcgtgactgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattaggcttggcagcgctattcttacgtccattgggttttgaatatcgcgcaaaaattgatactccaacttggggcacagtttgagactggccatttttcctaggtgggtctgaccacgattaattatgggggccgctcttgaaacttcatacaatgcgctaccttgccttcacactacgactgcactctttcatcgcctacattcccctaatccatctgctcctatctgttcctcctctcttaccaccccaaacaatccatttctcctcctcctttttgttctcctgatccctcctttgcacccctccccctcgcgcacgtttcactgttattgtccgctatctatcctcagctgcagcaattagcgccatcacctctataccacccgctttcttcattcccccagccctgccccaccccgtccactccacactatctgcctgtccatactctttccatctatctatcacacgttctacctactgcaccagcgactccctacaagcggtacttaacttgtctccttctcctttcaccatccctcacaactcatcacc

SEQ ID NO: 156 - DNA, 1246 bp, H. influenzae
ttattttacccgtatagccacgtagcgatgatgtgacaacacaccactgtgataactagctcgtgaaatcacttcgtatcgctcgccgtcaaatagcactactgcgacattgtgtgcattttctccagccaccgttagtttttgatcggtgtaaatttttaccgcacttgaaacgcgccgcccctgcattgataccactaggcgatccatttcagcactgcttaacggctgaatggatgccattaacgtctgctcgatttcgccgtcgtttacccacttgcctttcacatactctccgtcagaacgcacaagtattttataaggcttgcgaaaagaagattgagaagaaaatatctgcatcagatttcaaccttataacgaattgaattgactaattgcgaggtatctacgagcggtttactacttttcttgcgcctacgcgtagatggtgcattcggtgtccaaggataagacgttagggtctttttctgcttgtcttgataccattgcccaagttttgaaagctcttgcaccaaatcatcccctttcgccacattctcgaccacacgccctaagtattgcgccaatgcctgttggttgtcttcaaaggtttgacgaataaaaggacgagacgggatatgtgccgtgccatattcattccaaataccgatatccaccaagctttcgcctgattcagaatgaatgcctgcatccgcttgaacgcctacttttacgcgtgctttgccgattttgtttatcaactcaagttctttttcaagccctttattgttgatttttaccttaaccacgctagacacaatgactccctacggtaatcgcaccaaggcgcacgcaaatattgtttagctcgttatactttgccaaaaagcgttcagcgttgccgcctttatcgctgcttgaaaaaattcacgttctaaacggcctcacgttcacgttggaatccctgccgcatttaccccgcttttcatcggactgaggccaacaaataagccgcataccacggccaccgccttcattttgctttctatcagataaacagtctggaacgtttatttatcaagccacgcttaacacctttattttccatatcttcaagactttggttggcttacgggggcacaaaaaacaacgaacgagtctgcccctcatttattacttctgcgttttatcttttggcgcttttttctccatctcccgcttctggggttccttaatatatcgctcg

SEQ ID NO: 157 - DNA, 1438 bp, H. influenzae
caaagctccggtacctccgattttatggaacagcatagtaaatagagggactgaattattgtttgataaagattatcacctattgcccagataataagaattggtcataggttagataggcttggttgtttagctaattatcctgaagcattagtgaaatatagactacatggaaaccaaacatcatcagtgttataatcataagcaaaatgaggtatctaaaaagataaagggggaaaatattacatattaccttaataagataggtatagatataaaagtaattaatagtgtgtcgttgctagaaatatatcatgtggataaaagtaataaagtgttgaaaagtatactttatgatatgtatatgagcttagataaatatactataacttcactcttacattttattaaatatcatcttaaattatttgatttaaagcaaaattttaagattataaaaaaatttatcagaaaaataaatgttatgttttagatggagtgttcagaaaggggaggaacaaattccaagtttgtctaggactaaattctaatttagtcctttaaatttatcttagataaacgataaatatatattttaaatgagtttaattataaaaaatcagtgccttactaagttaaggcactgattaatcatattagactttaatgctattagttatagcacagaaacatttaagttcgagccgccaccaacaatacgaactcggcgaccagctacaaaactgctgtcagccttttgaacaacaacgatctcttgaccatcatcttttttaattacaagttcagcaccgtttacttgacttactttctcttcgattttgcttccagctactgcaccaccaatcgcaccaactactgctgcgataacttgaccacgaccaccgccaattgcactacccgcaataccacctaacgcaccgccaccaagcgtaccaattacgccttgattatcagcttggatcttaacaggacgcacagaaacaatcgtaccataagtaattgaacgagcttcctttgcttgagatgcactatacacatcgccactaaaaatatctgtattcgtacatccagccacactaaaaatagttaagatagctaatgctagtgttttctttttcatatctatatccttaatttaagaattaaaatggatttcttggcgaaaatgatgaaatattctttacttggctattattagacaccgtcacacaagccccaatagcaagagttgaatcatacttatgcacaataataacttcctctcctttctgctggttaccagaacaatcatttttacgaatagttaatttaagattttcgccttccatttggctaaaaacgatttgacctttaagcattttcatcttttttgaaaagaagaacaagcactcagggtaccgagtcgatatcgtataaa

SEQ ID NO: 158 - DNA, 1676 bp, H. influenzae
  misc_feature (1581)..(1581): n = a, c, g, or t
agcgagcatttttgattatctgaaaaattcaattatcgtctaacacggaattttttctgtgccttatcaactttcaacaaataattgcgtgcttgtgatgatgggtgaactgtcgttagaatgcgataaacttgttctggatacatttgattgattttgtaaatcgccgtatccttatcattatcaaaaacacgtaacactgcgcctgcaccactattatatgcagaaatcatggcgaaacgttttgaggttggattcgtaattccatctaaatattgattttgtaaaatccataaataagacacaccagcatcaatattattcgcaggatcatataaataacgcgttgatggctgcccacctttgcctttcattgcaaatacatctcgacctgctgtatgaggcacaacttgcattaatccaatagcatttgcgtagctaatcgcatatgggttaaaacttgattctgtttgcataatgcccaaaatcaaactttcatcaatgccataacgttgtgcagctttacgcaatcaatggtaaatattttcgtgcacgcacttctacgtggtttgcaatcataggaacagaaacaaattgcacggtatgcccgttttgtaatcgacgtgtttgcaatttattttgaatcaaataagtggcgaaattacttgcgataacttgattagcaatttgttgcccttgatgatctacaacctgccccaaaagaaatggacgagagctaatcggcacatcgccagaagtaaataaatcaataccttttgcatccgctcccattaacaaggtatgaacaatagcattatgtaatcgatttaaatcttgctgggtttcaataacgatattaccttcatcaaaactcacatggctacgcgtataaaaagaatctgtatatttcacataatctttacggcttgccactaacaattcattgacgccccaaattcggtcaatattatgcgagaactgccctgtgagaatatctaacccttgcgtgtctttagcaaaggcttcatcatagttaataccttgattcgatgaattactacaagcatacaaaaaaggcaataatgccaataataaatattttttcattgtaggatagataactaatttgatggtggaacataaccttcaatatgaacatctttaccttcaaacaaaaaattaaccatttcttgttctaataatttacggtgctctgcattcatcatattaagttttttttcattcacaagcatcgtttgtttcttaatccattcaccccaagcctgtttacttactgaatcaaaaatacgcttccccaactctccaggataaagttgaaaatctaagccttccgcttcttttttgagatattcacaaaatactgttcttgccataatgattcccttacaaattgtataaaagatttttcacaggcctgagcccagcccgatcggttcaggattttgggggatcataccaatatttgaccgcacttgataagggttgattgggacttcttttgggctttccatcactttttcggccaggctaaatatagccggctctacgcattaagggctnctccatttcaacatatattggagtgaaatctaaaagaaaagggctaaatgcttggccgaaaaccgggccattttggataaggcccggctttttct

SEQ ID NO: 159 - DNA, 1318 bp, H. influenzae
cgaaaacttggccagaataaaaagcgtatggccttgagactgccaagttttggccgctctttttatttcccccaccttattttttaagcagattattaaaaatctcctcaaatatctggcggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatataaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaataggaagttcatcagtaaaccacaactgcccctgcggacaataatctgaaaaaattttttgttgttcaggaaaatgacgaacattggataattttacgatcccaaatccttgagatttcaataccgcctctcgcaaacaccaacaacgataaaaagcgttcaaagaatcctgctgatgatgaaaccaatcaatttcttcttttggtgcaatatgctccatcaacgctgtaaaatttcttattttaggaaattcaatatcaattcccaccgcacttttttcttcttttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaattgagaaaatagcat

SEQ ID NO: 160 - DNA, 1113 bp, H. influenzae
tatggggaaaattaccgcactttttgtactgctgcgcgtgattggcattggcaagggtgccattttcaaatactttctcctcacaacgttgcgacacgagctgataatccccattcttgtgtgattttagtcgatgatggaaagaatagcgttttgctaactggcgatgctgaagcaaaaaatgagcaaatttttgcccgcactttaggcaaaatcgatgtgttgcaagtggggcatcatgggagtaaaacatcgacaagtgaatacttgctttctcaggttagaccagatgtagcgattatttctagtgggcgttggaatccgtggaaattccctcattattcggttatggaaaggcttcatcgctataaaagtgcggtagaaaataccgctgtttcggggcaagtgcgggtaaatttttttcaagaccgattagaaatccagcaagctcgcacaaaattttccccttggtatgcgcgtgtaattggattatcaaaggaataaaaggtacaatgcgtgcaatttttactattagatagcgattatgcaagagcaaaaattacaagaaaatgatttttcaaccttacaaacttttaaacgtttgtggccaatgattaaaccttttaaagcagggcttattgcttcaggtattgcgttagtttttaatgcattggctgattcaggcttgatttatttgttaaaaccgttgttggacgatggttttggcaaggcaaaccattcatttttgaaaataatggcttttgttgttgtgggaatgattattttacgtggcgtgactaactttatttctaattattgcttggcgtgggtatcaggcaaagttgtcatgacaatgcgtcgccgtttatttaaacatttaatggttatgccagggagtttctttgacagaaattcaacggggaaattactttctcgtatcacttatgattctgagatgattgccagtttcttcttcaggatcttttgataccattgtgcgagagagagcatatataatttccctattggcaaggatgtttatacaagctggggattacccctcgtttaatttgtaaccggcccattattgcagggtggtacccatcgcccaaa

SEQ ID NO: 161 - DNA, 1505 bp, H. influenzae
  misc_feature (1458)..(1458): n = a, c, g, or t
  misc_feature (1460)..(1460): n = a, c, g, or t
  misc_feature (1469)..(1469): n = a, c, g, or t
  misc_feature (1472)..(1472): n = a, c, g, or t
ctggtatacgaatatcggcctcggtaccctggctttagctggctgttcaaatctacttggtagcaatttcacgcaaaccttacaaaaaaatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtcccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaatncnccggggatnccntagagtcaaccgcgaggcatgcaagtaaaaggc

SEQ ID NO: 162 - DNA, 1496 bp, H. influenzae
  misc_feature (1392)..(1392): n = a, c, g, or t
aatatataagtgctgaaagcatctaagcacgaaacttgccaagagtatgagtcatccctgactttaagtcagtaagggttgttgtagactacgacgtatataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcgaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaatctatgatttggatattttttgtcatcgcactttccttggtacctggattgactctatatgccaatccgttattaaagcagtttaaagctcacaaggaattggatgctaaagctaagaatactgggntatacgattaaagagagcttgatttattgctcgtgcatgcagactggagaatgtaattttctgaagcggaatcgccttacaagccataaggctttttaaagaat

SEQ ID NO: 163 - DNA, 2238 bp, H. influenzae
  misc_feature (1728)..(1728): n = a, c, g, or t
  misc_feature (1749)..(1749): n = a, c, g, or t
  misc_feature (1846)..(1846): n = a, c, g, or t
  misc_feature (1997)..(1997): n = a, c, g, or t
  misc_feature (2038)..(2038): n = a, c, g, or t
  misc_feature (2072)..(2072): n = a, c, g, or t
  misc_feature (2127)..(2127): n = a, c, g, or t
  misc_feature (2204)..(2204): n = a, c, g, or t
  misc_feature (2209)..(2209): n = a, c, g, or t
  misc_feature (2211)..(2211): n = a, c, g, or t
gccttcttgctgcctgcggtcgactctatgagacccccttatgttttaggctattattacactgctttaaatttaattgagcattttattcattcttatattgcttggtgtgtatggtggttagtacgtaatacgatttaccgtggtattacggtttcttctcgtcgtttagcacatcgccgtttatcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataagggggaaattatggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattntggtattgaagtccgtggttntttaagtcaaatcggtcatgtgaaaatttcgccacagatcatcggagatattgattgggaaaaggtaaacagcaatccattcttttgccctgatganagtgcggtagataaattcgatgaattgatccgtgaacttaaaaaagaagagattctattggtgcaaaacttactgttattgcagaaaatgtacctgtaggattgggcgagccagtatttgaccgttagatgcagatcttgctcacgcattnatgggaattaatgcagtaaaggcgtcgaaattgtgatggtnttgcagtgggtgacaacgtggttcggaacatcgngatgaaatgacacctaatggctttgaaagtatcacgcaggcggcttttaggcggnatagtttaggacagccattattcgccgattgcgtaaaacaactcagtatacatttctggcgttcaataatctatgcnagcantnaaagtgggcaaagtcgtccgatcttgg

SEQ ID NO: 164 - DNA, 1297 bp, H. influenzae
  misc_feature (528)..(528): n = a, c, g, or t
  misc_feature (530)..(532): n = a, c, g, or t
  misc_feature (538)..(538): n = a, c, g, or t
  misc_feature (541)..(541): n = a, c, g, or t
  misc_feature (543)..(543): n = a, c, g, or t
gcctgcttgctgcctgcggtttgctctaggagatccccgctacaaaaagctgcgggaaaaacgcccaagtaaatttcaagctgttctacaccttctgatgccacttgaataatgcttgaggtggattgttgattcacttggttaagcggcatagaagccaatttacgatagataaggctacgcaattcatgcttcacttttgtgctggcaaaataagacgcctgcacagattttttccctgcaaaagcacgcaatgccaatgctgcaatcaaaacgatgcccaaaatgaccgcacttaacaggctcaatttgtgaaaataagccgcctgtaaaatataagaaaacacgacggcactaataatcccgccaactaacgccacccaattccacaacaccgtgacgccaatccattttttgctgtcagccaccgtgttaattaggcgtttatctatcatcataatgattactcctaaaataaaaagaagtacgcatagaaagaattatacgtacttaatgtagggtgggctncnnnaccccnacncnccctcccccccctcccatccagcctttgtcttaagctacccccactgccgccgcgcccccagcctcgcgcgcgcgggctaccctcctcggcgccctcctctcccgcgctcgcccttctgatcattcccccgacctcccgtttcaccctttcccactcgtcctcccgcttccgctccattcccccctatcccccccccttccatgctactccgtccgtctaccgccgtcttcccccctccccgatcccgctcggcgcctcccaccccctacttcccgtcccctgcactctcccccacccaatcctctttcccctcccgcctctcccctcgtccccctctcccgcatcctcctttccccccctgttcctccccccccccctctcccccgtcctgcgtcgcccatccttacacccctcccctcgcccccgaccccccccgcatgctccccccccctctcctcccccctcgtccctcccccgccccctttcccccctcccttcccttcccctttccctcctcccgcccccccttgtcccccccatttccccccccccgcctctttttcccccgcccccttcccccgtaaccccacctcctcccctccccgctcccccgtccccgcctttctctccttcccgccccccctttttcccctctcccttatccccgttccccttccccccgtccgccccctttttcgccttccctccccttctccccccctctcttccccctctttcccgccccctcccccc

SEQ ID NO: 165 - DNA, 1640 bp, H. influenzae
ctggtatacgaatatcggactcggtacccattgcttggattattaaaagtaaaggtcgtaatttaagtgatacctatttagtagagcatagttttcattttgatgaagagcagaaaatgttcccttttatggatgagcttagtttaggggattattctttcacgacattacaatattctgcacaagcgattcagtttaatgaagatgacgaaccttatttcttggtaaaattagagcaagaaatttcattagaaaatagcgaaatttttgaacaagtagaacgttttgaaaaattggctgaacaattttcgggagagtatatcggttgggaatgtgattctttactggatagcaataagccattgaattaggtgtttgaaacattcataaatcataaaaaagagagagttatctctcttttttaatgtaatttaacttttctgcgtattttgcgcattaataaaaatacccacggccatagtaaaccagaagcgaatgcgcctaagatggcttgccaatgaaaaaaggcagtatggagtgaaaattcaactaagaaaataagtaatcttataatgaagacgaaaagtacaaccaataaactttggaaccaaagtgataaatttcgcagaattaaatagtttttggcaatgatgtacatgctcgtagaaagtacgagagcgtgaacgcctaatgtagagcctaatattaaatcccaagttaatccgagtaaaaatgaccagcctatacttactttattgggaatagctaatacccaataaagtaatacaagtacaagccacgcaggctttagcatttggaaaccaactggccaaggtgcaagttctaatacaaaggcaataacaaagaagcttaaaatagtgaaccattgtaaaataaatcgtgtttgcattagtcttctatcctttcttcttgctgttctatgggaagatcttcttcattttgaagaaaatctgttggaatatctggttcaataatggttttttcttcattttctagaaagtctttttctgttaagggtgtttttttcactctataatttgcttcattagcttggctttctaaacgtttttgcaccagattgcgaacttcttctggcgacattgattttacttttgatatatctaggttacttggccaaagtaaaagtacataacgtaaacgttctaataaagctaaaggtttagctttaactattgcaaagtaattagagctatcacgcgaaacgctttgtacaacagctacgggatagccttcaagaaaacgtccaccaagcccagaggttacgagaagatcgcctttttctatatcaacggaacgaggcacgttatcgaggcttagttcatcggtatgcccagtcccactcgcaataccacgaacatcatttcgtagaacttgcactggaattgagtgtgttacgcctgcgaagagcagtactcggttagtattcttgcccacggaaataattggccaatgacgccttttttatccctgacaggctggcactacacaagccccgtcttttttcgctctgtttacaacaatcttgtgggcgaataaacccgcgctctgccccagacctcctgtcactttctgtgtccatccgcccccacgcgcgatcg

SEQ ID NO: 166 - DNA, 1567 bp, H. influenzae
gcctgcttgctgcctgcggtcgactctatgagacccctgcgtaacttgaacgcgtgggcgctgaggcaatcaagataacgccatttttaaccgcacttttctcttaatgcagccgaaatcgatttgacggcgaccgcgttgcggaatctgacagattaagcgcattatcacattaaagcgcggttaaaaatggtacacaaacaaggagccaactatggcaactatcatcgtaaagcgtgatgcaggttcacgcaaattcaccgaaaaaggcgaaattttacaacgtggtaaagcgggcagattagaaagaatgttcgataaacaacgtcgcattaatgccgcgtttgaaaaaatggtggtaaaagaaagtgcggcggatcgcgcaattaaatttgcagccaaccgccaaaaagagcaatttatcgacatagccaactaccactgctgcaaaggtaaacctgctggtacaaacaccgtgcacgcagtgcagaagcgcagactaggggtaagagaattaatacgatagcctcggcttgagccttacaagcataaagaaaggcactctattctagacaaaatcagcatagactgattgcactactccactgaccgctcgaaggggcggttttttaagggtatttaaaatgaaaaataaaatcacagacttaaacaatcatttattttcccagttagaaaaactgcttgatgaagacttaaccgatgaagaacttaatcgagaaattaaacgtgccaatgccgtatcaggcattgcggcaaatattatcgcaagcaatgcgatttcgcttaaagcaatgacattgtttgaaaatcgtcaaattgataagagaatcccctgattttctaagaatatctaaggcgcaaggcgatgacctctaatgcggaacgatttaaattcaccgatgaacatattgcgtttattcgcttacattgggataaaaagccatctgatctaattaaattgtttcagcaacagtttgatttattaataaatcgtaatgttttctataaattaaaaaagaaacacaatattccaagccttaagcatgctaatcgttacagcaaagaagaacttgcgttcattaaagcgaattgcacgttaaatgaaagaatcttggctcaaaaaatggaagtttatttcaataaaccatttaatccacacgcgttaaaggttttgcgcgtgaagagacaatggctaaccggacgaagaggtcgatttgagaaaggtgaaaatttcaaaccgattggctttgagcgatattgtaaaaatgcaaaatgttggttaataaaagcaagcattaaacgttatgaacggaaatcgcattatctttggcgcaaatccggtataaacattcgcgttgacatattattgattaccaagacggcaatttaagaaattgcccccttggaaaatttcgaattaatttcacgggttgaaaaggctttggccaaagaaattacggttcccccactccatgattgaaaaaaaccccctttttccgcttttggaaaactacagaaggcctaaattcaccgcaataagaaaaat

SEQ ID NO: 167 - DNA, 995 bp, H. influenzae
  misc_feature (873)..(873): n = a, c, g, or t
  misc_feature (885)..(885): n = a, c, g, or t
  misc_feature (893)..(893): n = a, c, g, or t
  misc_feature (986)..(986): n = a, c, g, or t
cccctttgcgattcttaaaaatagattattgattatttacgtcagaaagggcggtttgttttagaaagtgaacttgaagatgaagataccaataattcattttttgatgaaaaggggcattggaaaccagaatattacccgagtgaattacaaggcgaagaagaaactgtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactttaggagaaaattatgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacattaagagtgatgaaagtattaaaaaatccgctattttgaccgcactttatagcggtatttctaacttatccatacggcattttgtaatctcaaaggttttatttcttcagcttcgccaataaactcactgcgcccacaattataactgcaccgagccaaaaatagagggtaaggcgtatgatgccaaaagagccagtcgaaaacgctagagaaaaccacgccagtgaaagcaaaagggagtatgatttgggcgggtgcgtatttaaaagcgcgcgtgagtataatggaaatcaatccgaaccgccaccatagtatagcnagctcgataatnaggatttncattggtataagaagatgtacatgacgtccatcgagaataaacgatttttggggtggggattggtaatcttgagcataagcatccgctaacgnacgaatcaa

SEQ ID NO: 168 - DNA, 1056 bp, H. influenzae
  misc_feature (1029)..(1029): n = a, c, g, or t
gattcggctcgtccccacactgatgagtcattgaagatgctggatttgacgccacagagtaaaaaatttcaattcagattggtgggatggcctgccaatcttgtgccaatcgcattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcacattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcgcattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcacattcatcaataaaacaactaacaaggagtaaaatggggtctcntagagtcgaccgcaggcagcaagctgc

SEQ ID NO: 169 - DNA, 1445 bp, H. influenzae
  misc_feature (1337)..(1337): n = a, c, g, or t
ccgttttttttgattcgtttgaagataaacgataacgacctacaccagagtgcgtatccaaataaaaaaagcctttttctttaagtttaaggttttccaaaataagcattaagacgatatgttttaagacatcagcatgattgcctgcgtgaaatgagtgacgataactcagcataatatatcctttgttttataacgaaggcgagccaattgactcgcccgatttcacactaaagtgcggtcatttttagaagagttcttgtggttgcgtcgctggcgtattgccttcattatttaagcgttgctgtaactctgtaggaacgtaataaccacgctcttgcatttccgaaagataggtacgtgtcggttctgttcccacaataaaatattctttgcgcccaccgtttggagaaagcaaacctgtcaaagtatcaatgtttttttccacaatttttggcggcagtggcaatttacgttcaggtttatcactcaaagccattttcatataagtgatccaagctggcatggctgttttcgcacccgcttctccacgcccaagtactcgtttgttatcatcaaacccaacataagttgtagtgactaagtttgcaccaaatcccgcataccaagccacttttgaactgttggtagtacctgttttaccgcctatatcgctacgtttaatactttgtgcaatgcgccagctggtgcctttccagtctaaaccttgttcgccataaattgccgtatttaaggcactacgaatgagaaaagcaagttcgccactaatgacacgtggcgcatattctattttcgacgaggcattttttgcagcagccattaaatcaatcgcatcttctttaagtgcggtgaaatttgattgtaattctggcagttcaggcacagtttcaggttgttgatctaattcttcgccattggtgctgtcatctgttggttttaaggcactctcgcctaaaggaatattggcaaagccgttgattttgtctttggtttcgccataaattacaggtatatcattacattcaatgcaagcaattttagggtttgcaataaataagtctttacccgtgttatcttgaattttttcaatgatataaggttcaatgaggaaaccgccattatcaaacaccgcataagctcgcgccatttctaatggtgtgaaagaggctgcgccaagtgctaaggcttcgctagcaaaatattgatcacgtttaaaaccaaaacgttgtaaaaattctgctgtgaaatcaatacctgctgtttggatcgcacgaatagcaatcatattttttggattgacctaatcctacgcgtanacgcatcgggccatcataacgatcaggcgagttttttcggtgccacatttttgtcccggtttttgaatgaaaacgggctggcttgtatacctaaaagccgtaagcctt

SEQ ID NO: 170 - DNA, 1187 bp, H. influenzae
  misc_feature (1020)..(1020): n = a, c, g, or t
ccccacacaattattacggaagaacaggcgcaattgaaggcaaagaaggcaaagatagcgatgtacaatggattattgatccgctagatggtactcgtaattttatgacagggcttccccacttttctgtgtctatcgcagttcgtgtaaaaaatcgcactgaagtcggggttgtttacgatccaatccgcaatgaattatttactgctgtgcgtggcgaaggtgcaaaattaaatgaagtacgtttacgtgtagatagtaaacgtgaacttcaaggttcaattttagccactggttttccattcaaacaaccaaaattaatgccagctcaatttgcaatgatgaatgccttaattgaagatgccgctgatttccgtcgtacgggttctgccgcattagatttatgctatgtggcgtcaaaccgtattgatggttattttgaaatgggcttaaaagcatgggattgtgctgctggcgatttaatcgtgcgtgaagcaggtggtttagtttgcgattttgatgctggtaacggctacttacgcagtggcaatatcattgctgcaccatcacgcgtaattaaagaaatgttaaataaaattcgcccttgtttaggtgctgaatttaatcattaatttttataagcacaatagcacctatcaaggtgctatttttaattttattaatgaaacatacttgattagcgactttatctgcgcatcaacgaaaaaaacgacgacattatgcttccagaacttggctttttccttcttttactcgcaacagctagcgcgttttttcttgcgttagtgcctcaatttgggttgttcaaaaaaaattcgactttaattaatgctgcttggccgcttagttatatttttacccttgcgacgacgttctcaatttggtttgcttacttattctttctgcggggatgatttcaccccttgatatgtagcggcacattccaactctcaatacctacattttttaaagtggctgccacttggggagacatgaagntccatgttggttttggtatttcattgagttatggctgctgctttgcttttttatcaaaaatgacgacttttcgctcatcttatctttatgggatagatgcctttggtttcggggttatttatttattccatcctttgacccttttcctgctcccaaaggggcgattc

SEQ ID NO: 171 - DNA, 1279 bp, H. influenzae
  misc_feature (1063)..(1063): n = a, c, g, or t
  misc_feature (1248)..(1248): n = a, c, g, or t
aagaaaaacttgccatcaccattagaattaatccccatttcagttcttttgctgaaattgcgcctttttgaatgccacgtaatggcccaatacgttcttcagtatctgaacctttttgatgatccccataatcattggcaaaattagaaagcacctgcaataaaattgtcgtgagtaaacaaagcaccattacaagcccattaaaaccttgtggattcgcccaataacctaatgccgaacccgtgaaaatcgatgccaacgctaagggcaaagttttcggtcgagccgtttcccaccacattttcaatttttcatttatcattttttttgaccgcacttttgattacaataagccgcgtattctacactaagacacccaatttatgaatgatttaaccttatcgcctatcgccattatccacacgccttataaagaaaaattctccgtaccacgccaacctaagttagttgaagacggagtaggcattgtagaactcttaccgccttataattcgcctgaagccgtgagaggattagaacaattcagtcatctttggttaatttttcaattcgaccaaatccaacaagggaaatggcaacccaccgtacgccctcctcggttaggcggtaatcaacgaattggagtgtttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcacaatcgagctttgctcaagaaaaaccaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggaacaagtttgtacgaatttaatgtgaaatggcgaattaaagcgggtacggnaaattgtgtagaatggattgaaatagaaaaagacaaattgtgtattatgtatataggcagggaatccctcgccctacggcattcataggcctattctacgaaatccggctttttttttgttttgtatgttcccccacttattgcctctctcccttttctcaccccggttgtatttattccgtttnaccatttgctctattagctggtcatttgtta

SEQ ID NO: 172 - DNA, 1517 bp, H. influenzae
acgtatcgcgatcttcattatcttcagccataaaattatgtttacgtgctgcttcaattaattctgaacgttctgctgacaagggatctaagcctacatattcttggaaaacaaattggtagcttaaactttctgcaggtggacaatctaaaatttgttggagcaaatcatctacttcattaattaaacgatgcatatgaaagtgcggtcgataccattccaacatagtaaattctggattatggcgatttccagcttcttcattgcgaaacactttactgatttggaatatcggcccactccctgctgcaagcaagcgtttcatatgatattcagggcttgtagaaagccaaagtgttttggattgttcaccgaaaggcgcaagaaattccgtgctaaaggtggagagatgtaaatcagtgacgccaaattcacttagaacaggggtctctacttcaagcaaaccgcgttctgtaaaaaattgacgaatttcagcaataatttttgcccgtttaagaagattttttatatcggcagaaggttgccaatgattaagtgcggtcatttttaatcctgttttaaaaattttgcacattgtaaacgagagctactctcaactcaatcttagcttttttgaggtagatcacaaaatacgatcttttccatctttagacataaaaaacgttattaatttgtaacaaaaaatggcacaatgcccacacaatattacccttttaggggatttatttttactttctattgattggaggatatcgtgcaaacagttaatgtcgatattgcgattgttggtgctggtggcggtggtttacgtgcagcgattgccgcagcagaagcaaatcctaacttaaaaattgcattagtttctaaagtatacccgatgcgtagccatactgtagcagcagaaggtggtgcagcggcagttatcaaagaagaagattcttacgataaacacttccaagataccgttgctggtggggactggctttgtgagcaagatgtagtggaatatttcgtgcaacattcccctgtagaaatgactcaattagaacgttggggatgtccttggagccgtaaagctgatggcgatgtaaacgtacgccgtttcggtggaatgaaaattgagcgcacttggttcgctgcagataaaacaggtttccacttattacacacgcttttccaaacttctattcaatatccacaaatccaacgttttgatgaacacttcgtattagatattcttgttgatgatgaccatgctcgtggtatggttgcaatgaacatgatggaaggttcgcttgtgcaaattaatgccaatgcggttgttattgcaactggtggtgggttgtcgtgcatttaaatttaataccaatggcggcattgtaacaggtgacggcttatctatggcatatcgtcacggtgtaccacttcgtgatatgggagtttgttcaatatcatccaacaggcttacctaatacgggtattttaatgaccgaagg

SEQ ID NO: 173 - DNA, 1569 bp, H. influenzae
  misc_feature (1310)..(1310): n = a, c, g, or t
tcataccaattaaaaaacgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattggtataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataaggcgatattcttttattaacaaaaagattgaatgtttttcattctattntaaaaattagccccaagtaatttgaatttggggctaatttattattacaatttaagatcttcgatgtgcatttttcataatgcgatcttttgttactttccattcccgttccttaatatcaatcacgttatcctgttggtttttacctttggctaaacggattttgactcttgcccccccctttttcattaacgacaagggcctctttgtgacaccgctctgcttgcttccgccgatcggttgcttcccgccccgtttt

SEQ ID NO: 174 - DNA, 2021 bp, H. influenzae
  misc_feature (1545)..(1545): n = a, c, g, or t
  misc_feature (1551)..(1551): n = a, c, g, or t
  misc_feature (1874)..(1874): n = a, c, g, or t
  misc_feature (1884)..(1884): n = a, c, g, or t
  misc_feature (1901)..(1901): n = a, c, g, or t
  misc_feature (1911)..(1911): n = a, c, g, or t
  misc_feature (1926)..(1926): n = a, c, g, or t
  misc_feature (1931)..(1931): n = a, c, g, or t
  misc_feature (1933)..(1933): n = a, c, g, or t
  misc_feature (1952)..(1952): n = a, c, g, or t
  misc_feature (1958)..(1958): n = a, c, g, or t
  misc_feature (1966)..(1967): n = a, c, g, or t
  misc_feature (1971)..(1971): n = a, c, g, or t
  misc_feature (1974)..(1975): n = a, c, g, or t
  misc_feature (1978)..(1978): n = a, c, g, or t
  misc_feature (1982)..(1982): n = a, c, g, or t
  misc_feature (1986)..(1986): n = a, c, g, or t
  misc_feature (1992)..(1992): n = a, c, g, or t
  misc_feature (1994)..(1995): n = a, c, g, or t
  misc_feature (1997)..(2001): n = a, c, g, or t
  misc_feature (2003)..(2003): n = a, c, g, or t
  misc_feature (2007)..(2007): n = a, c, g, or t
  misc_feature (2016)..(2016): n = a, c, g, or t
tgataaaacttgacgaacaccgctttcaagcgtaacattcgcccgattttttaacgagaaggacacacactttggacagtcatagtcgataccgaatatcgctctagacgctcgccttttattatcggcgtgcgttcgccggtaaatttaccgttgtttcggcatctcttaacgaaaactttgcgattttttaccgcactttcgtttcttctttaatttgttcactgttagctgttcataatcctataaggagtatgaaatgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcactgagaaatcttacgagatattgaatctttgcaaccgcataatgaatcattattccaaaaagtaaactttttaatgcaagctgcattggtttacatcaatattgaacagaacaaaattatgaatatcttctcggttgcttctgtgatgttcctttctgcaacattacccgcgcttacttatggcatgaactttgattttatgcctgagttacattttaaatatggctatccaatggcaattggattaatgatcgcagccgcactgacaccatatatttattttagaagaaaaggatggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattgnggctgntttaagttggtttaatcgaggtattaattttataagttatgccttttatcaactctccgaaccccttttaaaacctatccgtcgattcttacctacattaggcctgattgatttttctccgagggccgttggatttaaccttaatacttctaaataaatccatcccgggatcttctagggggacttttggctttttgcctgcttataaatttttatgcccctatctgaccatcggccttttataaattttttttatattttttcttgggctatactcttctttttttatctcctcccttttttatttcctgtttttctaggcncttgggttcntccttgtctttcggctnccttttttgncctcgtttttttctnctttntnttttgtctttcgtctcttntgtccncttttttnncttntcnntcngccncccnctgccncnncnnnnncngccncccctctcncccgg

SEQ ID NO: 175 - DNA, 1591 bp, H. influenzae
  misc_feature (1534)..(1534): n = a, c, g, or t
  misc_feature (1551)..(1551): n = a, c, g, or t
cgatgtccaagtggcatagccttctaaaccaagaccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaatggtgtgcgttctctaagaattttttatcaaaaccgctgtgggtgttgaaaatgcctgtttttgcctgttcgtgtaaaaattgtgcggcgcagatgttggcaataatcattgcttcttccacaatttgattggcaatgcggcgatattctgctttgatttcttgcactttgccgttttctgccagcacaaaggcataatcgggtttttctttaaagagtaaggaatgggttttgtgccattgaatgcgggctttggtaaattgatgtagccagtgaatttgttgtgctgtttctggcgtttctggctgccatgcattgtctgcctgttctaaataatccgacactttgttataagccagtttggctttagattgtacataagcggaaacaaaatgcggtttggctgtgatgttgcctgcaagatcggtttcgatataacagacaagtgcggggcgggtttcattggcgattaaggaacataattcatcggataattcacggggtaacattggaatgttaaagcccggtaaataatttgtgaagcaacgctgtttggcttcttgttcaatttgagaatctaaggcgatgtaagcggttgggtcagcaatggcgaccactaatttccagcctgtttgtgtgctgttttgtgctatgggttcgatatataaggcatcgtccatatccattgtgctttcggaatcaatggttacaaaatgaagtgcggtcagattttcgcgtgttttttgatctaacatttcataatgttctgcgccttgcacgggatagcgcgattgttcgtggcgtgccaatgtgacccaccaaggggctaattcatcgtcagctcggcaaataaactgattaattgtggcgtagaaaaagcgatcgtcacgtaatggatgggtttttaaatttgcgacgacccagtcgccctcttgcaattcttcttttaccgatttcgcctgttgtgcaccaatgggttgattaatgcttgggtgatccaccagcacttgtactttcttgtctttattgaaccgcacttttgcgataaaacgtgtgagcattggctcaattaaagcttctggctcggcttgctctttgtcgccttgcttttcaataggggctttgattttgtcgcccgcgcatcactttttttattgaaggcgttgcgaggttaagggttttatatcgccctctaataaaccgaaggctttttctgtacttcctaccacccctcgcccttgtctatgcttttcggggttttgacgttaagtttttccagtgccagacctatccataccnccattttttggtctggnttaatacacccctctttcattctaaaagcccatttttcac

SEQ ID NO: 176 - DNA, 1139 bp, H. influenzae
  misc_feature (1057)..(1057): n = a, c, g, or t
  misc_feature (1071)..(1071): n = a, c, g, or t
  misc_feature (1127)..(1127): n = a, c, g, or t
gcagcttgctgcctgcggtcgactctaggagacccccattactacgcctccaatttttagtggtgcgcgcactttaagtccgccaatattattaaaaattgccgtcacggtataagatttcgtctcagcaaaaccttgtacattagctacgcgtaaacctaaaaaaactaaggcaccaataccaagtaataaaaataacccgacccaaaattcatatttaattgtttgtctcataaaaaatccttaacttgcgccaaacataatagcagtcaaaataaaatctaatcctagaacaacaagtgaagcgtgcacaactgttcgtgttgtagcttggctgataccttctgatgttggcatacaatcataaccattaaaaagtgcaatccaagttacggctacagcaaagaaaaccgctttaataaagccatttaaaatatcatagctccaactcacggaattttgcataacagaccaaaagctgcctgaatcaacacctttccaatccacacctactaaggaactgccccaaataccaatcgcgataaacaagattgacaaaattggcatggaaataacccctgcccaaaaacgaggtgcaatcactcgacgtaaaggatcaacagccatcatttcaagactagaaagttgttcagtggctttcattaagcctatttcagccgtcaatgcagaacctgctcgaccagcaaataaaagtgcggtaacaacaggccctaattctcgcaaaagagaaagtgccaccaactgacctaaacttgtttcagcagaaaaatcaactaatacgacataaccttgtagtcctaataccattccaataaataaaccggacaacaaaataatgagtaacgattggacacctaaaacatgcatttgcttcacaagcaaaggaaaatgcttacgaatttgtggcttgccgatcaatgcaccaaataacataaagcctgctcgccccaatgcacggaaaaagtcgatcacctgttttcctaaagcagaaatataatttgacgatcattcaaacaattccttcatataatcttgncgctgggtacttanagcgcacaggaccatcagattaccttttaagaatgcaccacgcgcgatcttggctntgtaaagcgcca

SEQ ID NO: 177 - DNA, 1586 bp, H. influenzae
tgttttcgaatatcggactcggtaccccatggaaatgaattaattttgacaaaattgtaaatgaaaaaacaatttttaatgataaagatgatgtaaacaaattagaagaaatggcaaaaatatacataaccaatcagaaaattaatagtttataacaggcaacccaaagtgcggtcaatttcaaaaaggtttttaaaattaaccgcactttcattccattctaaaaaaatcctaaataaatattatttataccgttttttcaccgtacttttatcttgctcacgtaatcgttctagtttttccttaatctgaatttccatacctctattcgttggaaaataatattgagtatcttttaattcaggtgggaaataattttcgcctgccgcataagcgttaggttcatcgtgagcataacgatattcagccccatagccaagctctttcattaaattagttggcgcattgcgtaaatgtggtggaacatcgtaatcgggcaaatctttcgcttgctgttttgctgtgttaaatgcagtataaaccgcattactttttggcgctactgcgagatatataatggcttgggcgatggctctctctccttcataagcccccactcgagtaaagcaatcccaagcagccaatgcaacttgcatagcacgaggatctgcatttcccacatcttctgaagcaatggcaagtaatcggcgcgcgacatataaaggatcgccacctgccgttaaaattcttgcataccaatacagtgcagcgtctggagcagaacctcgaacagatttatgtagcgcagaaattaaatcatagaaacgatcaccttgtttatcaaatctcgcttgacgttcgcctaagacttcttttaataaagtgtggccaattgtctttgcattttccatttcatctgccatatccaccattaatccgaggcaattcaaggctaatcgtgcatccccattaacacatgcggaaagcacttgccgcccaaattctcctatagttaaccgttctttaccccatcctcgttcaggatcttttacagcttgttcccccaccttgttgcatgtaccctgctgtgaccgctctccttacatcctctcggcctccagaagggcttcgcactattcatccccccatagctaccttgggcctgttgaccatattagctgtatgttcccgtttcccgctccctccactcccctcccgctgtcttttcttcaaccgcgcccccctgcccattccgcattttttatgacgcccccgaacccattttttacactcccttttttgtggcgcggcccgctgaactatcctgtacccgccgccccccctttttcttaccgctgccccacctcctcctcgtcgcgtcctcctcgtttttacgcggccgtgtatctctgtgttatatctgattatttctctccttctcatcccccctccattctttctctcgccctttcgcctatttttttatcccctcttttgttcctatctctcgcgccgctgttcttctcgcacctcgtccgtagtagttattttcagcctgctagtcgattaccctcccagtcgcttcg

SEQ ID NO: 178 - DNA, 1211 bp, H. influenzae
  misc_feature (16)..(16): n = a, c, g, or t
tggtatacgaatatcngactcggtacccgttttagtttttgcacttcatctacaatttttaatgtggaacttatggtttctttaataggttcggcaagtggcatattgtaggcaaagagcaaggtcgctaaggcaataaatgttttattacgataaaattttatgccaaatttcaccgcacttttgtactgaagaaaaattaaaataggaatggcgaaagcaattaagtaactactcactggaatttgcaatagaaattccttcgtttccaatatatctgtcgcgaaaagcgaggcgatatattgatagcttggagggccaaaatttagccccgtaggtgtataaaaagcatgcagtaacgtaagaggtagcaaaataaaatagaaggattttttactgctgcttaataagagaatagttattgtcgcaagcagaataagatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaaattaatgtccgctttccaattaaatggtatttgcgatacttataactggtctgaagcaatcaaaatgttacgcgaaaaacgcgtagtcattttctctgcgggaacgggaaatccatttctttaccactgattctaccgcttgtttgcgtggtattgaaattgaagctgatgttgtgttgaaagcgactaaagtgatggggtaccgagtccgatttcggtacca

SEQ ID NO: 179 - DNA, 1865 bp, H. influenzae
  misc_feature (1495)..(1495): n = a, c, g, or t
  misc_feature (1646)..(1646): n = a, c, g, or t
  misc_feature (1677)..(1677): n = a, c, g, or t
  misc_feature (1738)..(1739): n = a, c, g, or t
  misc_feature (1752)..(1752): n = a, c, g, or t
  misc_feature (1754)..(1754): n = a, c, g, or t
  misc_feature (1757)..(1757): n = a, c, g, or t
  misc_feature (1769)..(1769): n = a, c, g, or t
  misc_feature (1772)..(1773): n = a, c, g, or t
  misc_feature (1788)..(1788): n = a, c, g, or t
  misc_feature (1800)..(1801): n = a, c, g, or t
  misc_feature (1803)..(1803): n = a, c, g, or t
  misc_feature (1811)..(1811): n = a, c, g, or t
  misc_feature (1813)..(1813): n = a, c, g, or t
  misc_feature (1827)..(1827): n = a, c, g, or t
  misc_feature (1833)..(1833): n = a, c, g, or t
  misc_feature (1836)..(1836): n = a, c, g, or t
  misc_feature (1839)..(1839): n = a, c, g, or t
  misc_feature (1847)..(1850): n = a, c, g, or t
  misc_feature (1858)..(1862): n = a, c, g, or t
tccccccggtgtccgggtctccaaaaacccccgcaatatatttcagggctttcttgttttttcccgtaatggtttaaccgagtcgcatatcaatggcaccttcgggacataaatagagcagggcccaatcccggctaataaacgttcttctttccccatgaataatattatgtgctccaggccgagtttgtttcactaacgcccgcagcctgttcacttgctgggttttttcaaataaggcaaggggtggtaccccctgatcgacttttcaattcgcgtatcgtcgtttgccacgacaatttcaattttctctttagccatatatcactctcaaactttcaaatgttgtgttttcattatgtagctaatctacacttatttttgtactagtaaactagttcgatatgttttttttagaataaaacctacgaattccctattaaactatctttacaactctcttgcaagctgaataaaacgaaataattaagtaaataaaagataaaaaaataccgcacttttgtgctgtactctcgaaattaatggctacttaatacttgtgcaggttgtaatttagcagctcggcttgctggataaaggcttgccattaaactcaatgcaagtgctgcaactaaaaccatcaaaacatccaaccaatgtaactcgcttggcaagaaatccacaaaatacacatcgcccgataataatttcttaccgataacccactcaataccttgaataaaggttgtaagatttaatgcaagtataatgcctaacacaattccaattaaacaacctttcattcctgcctgtaagccataccaaataaaaatacgtttgataaacgcattattcgccccaagcgtgcgcataatggcaatatcgccctgcttatcttttaccgccataatcagcgtagaaacaatattaaaacacgcaacaccgatcacaagcaccattgcgatatacattacggttctaataagctgaatatcgcgatacatataaccaaatttactaatccaattttgcatatatagcatctgcggataatcattaagcattgataaatccagatttctcgcagaaaaaggatcatctaatttcaattcaacacctgtaatttgatcaggttgataagtcaaaaaggtttgtgcttgagcaagcggcaataaggcataactataatcaagctgaccatctaagcgtaaaatagcggtaacttgcactggctcacgagttggttgagcaaattgttcatcgccgttttgctgagaaataagcaaggtaatccaatcccctacttttacatcaagttctttagcgatacccgctcccaagaccaatccgccttctttctcaaatttgttccaaccttgctcttgtacaaaattgccaattgaacttaccttatcttctgcttgtttttcaacacctttgacctgaaccactttcaattttgagccattttctaccaatgccggaaagctaacanaggagagaatcctttaatttgggggattttggtggagggcgtttttctaaattttggcaatgatgaaatgggggatctttcgcgtgggtgcgcagaaaaaatgtgaatgtgcggggcgacggggcaaatcccgtggttaatcttacggctncatcccttgctcgcccttagggccccatttnagttggggcccccctggcagtccgttgggggagaatttgggtttaccgcgcttaggggatnntttgggggcccgngngcncccgccgcgtcngcnnccggggtgtttgtcngcccctcttgtnngnccttctgntnttctctccgcgcgnaccctnccntcncccctccnnnnggggcttnnnnnggg

SEQ ID NO: 180 - DNA, 1320 bp, H. influenzae
  misc_feature (1205)..(1205): n = a, c, g, or t
  misc_feature (1210)..(1210): n = a, c, g, or t
gagaccccacattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggcggaatacctcgtagagtaaagcgtcctaaagaacgacaatcatcgactagctctcgttcgccttgtagcacatgaacactcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactcgccaacttgttctcttacataaggcacgcgagttgaaccaccaaccattactacggcttgtacttcttcggattccacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtgtctccccccgttgctaaaacttcaaagataccttttgataaacgtaaaattgaaatatcaaatgtgccaccgcctaaatcataaaccgcaataatgccttcttgcccactatccaatccataagcaagtgcagctgcagtagggttcattcaataaacgtaatacatttagcccagctaaacgcgcagcatctttattgctttgacgctgagcatcatcgaaataagctggaactgtaatcacaaccccagaaagctcacctcaggggcggtgtctgcaatgggatttaagcgcgataaatatctgaagcacttaattggacttttaggcccctgtgcggataaattaagggatccatttnactcngccaattctaggcaactagatacgagatgactcaggagctgcacaatagcgtttatgaatacgatttttggacaggaaggtgctaaagctttaacactttttcttaagct

SEQ ID NO: 181 - DNA, 1827 bp, H. influenzae
atatcagactcggtttctccgtcaacgtaacattgttagcttgcctggatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttattaatgaaattaaggagaatagtatgcaaaatattctatttatatcccatccagccccttatggggaatggaagctgccaaagtattaaatttttaattttctcgatagctaaaagaaaaccccgccacaagtgcgggatcttttttgcttattttgttgcagctttcatcgtttgaacaaattcagctaattcagctaaacatggctcgtgattatctaaatttcgctcaataatttttactgttgccgaacctgaaattgcaccagccgctcccaaagctaaggcttctttaacttgtgcaggctgtgcaatgccgaagccttgtaaaattggcggggcatagtgggctttaagttgttctacaagggtatctaaatttgctgcgtgagcttgattttcagcactggttacgcctgcacgtgagactaaataggtatagccttcgctatttttcgctacgccttgaattgttttctcatccgcatttggcgggcaaataaagacgggttgaatgccgtgttttttggccgcttgtacataatcttcttttgcgagtaacggaatatctgctacaagcacagcatcaacaccaacttctgcacagcgttgataaaaagcatctaaacctttagcaaaaattaaattggcacaaagtaataagctaatcggaatctcgggatattttgaccgcactttttccaatagtttaaagctatcttcactgctatgacctgcagttaaagcacgattattcgcggcttgaataactgggccatcgagtagcggatcggaaaaaggaaaaccgagttctaaagcatctgcaccgttatccacaagtgtgcaaatgatctcaaaagagcagtcgaaagtagggtcgcaaagggtaacgaacggcacgaaagccccttcattttttgcgttaagtgtcgcaaattgcgtttcaaaacggctcattagttcgttcctccatttaaaattttatcaacagtaaaaatatctttatcgcctcgtcctgaaagattaaccactaaaagttgttctttttcaggattttgtttaatcaatttcaaggcataagccaaggcgtgtgagctttctaatgcaggaataatgccttcgtgttttgccaattcttggaatgcgttaagggcttcttcatcggtaatcgatacatatcaggcacgaccatgggtaccgagtccgaatcgtatacca

SEQ ID NO: 182 - DNA, 1910 bp, H. influenzae
acggtttgcgcaaactgtggtgcataagtttctgggaacgcataacctaaactaccgccattcgcacccgataaataatctttagaatattttaaagccgcatcagcaaaagttgttttacctgcaataatatcagaacgaattttagctaattgtttttttgcttgagcatcatttaacaatggattaagttttaacaaaatgtgacgcacttcgtattctttacctgtaactttttgtgcagtgccttgtgattttgcctcatccaacattttttgaccaagtgcaaccacttcttcacgcgttacatcaatactttcttgaatagctttgttacgtacagcccccatcaccatttgattggcaatttgctgacggaatgtatttaatgaaatgccttgataatctaacgcatccaaaaattgaccataagttaagccatttctagctgcagtgtcttccacaacacgatcgatttcacgaggatcaattttcacaccagattcttgaatcgctttttgcactaaaagatcatcaataattttatcaagtgcactttggcgatcgccttttttacccatattggcacgaacttggctttctaaaataggaataccatctactgtcgcgacaacacgttcctccgcttgtgccatagaagtaaaagcaacacaacctaaagtagccaataaaaaagattttagaataaattttttcattttcatctcatcaaaaaagagtccataacgttggttagagtaacaattctattgaaggttcacaatagataagatttatttccctagaatagcaacttcgtaacagccatcttgtttttcagtacgaacttgtacaagttcatcacggcttgttggcacatttttacctacgtaatcagcacgaatgggtaattcacgatggccacgatcaacaaaaatcactaattcaatttttgcagcacgaccaaaatcagtaagcgcatccattgccgctcgaatggttcgaccagtaaacaacacatcatcaaccaaaatgacggttttatcttgaatattcaaatattgtgatgaaccactataaactggcattttatcttcctgatcaaccaaagttaaatcatctcgataaaaggtaatatccagttccattgaaggtaaatttataccacttaactcttcaactcgacgttgtaataattctgcaatttccgcgccacggcgtttaattccaacaataacaagatcatctaaggtttgatgtttttcaataatttcgtgagaaatacgcgaaattgtgcgaagaaaacgatcatgatcaataataattttttccatttttcccagctttatcaatagtatttcaatgcacaaagtataaagaaaatacgcctaaaaagcgacggcatttgcaccatgtttcttgttcgttatactatccaaaacattccatcaaaggaaataaaattatgcactactctattcaagattttattcaactcatcgcccaacttcgcaatccaaatggcggatgcccttgggatttaaaacaaaattatgaatccatgattccttgtttaacggaagaaacttacgaagtaatcgaagccattgagaaaaaagacataccaaatttacgtgaagaattaggggatttattgttgcaagtcgttttcttcagccagcttgcaacggaagataaatactttacttttgacgatgtgttacaagatatcgctgaaaaaattgtacgccgtcatcctcacgtgtttggtgatgcaaaagcgggggacgaaacagaagccctttcccgttggaacgaaatgaaagccaaagaaaaacaaggtaaaagtgaagaaacctctttttagatatggccggggtcctttagatcgactgcaggcagcaagctgc

SEQ ID NO: 183 - DNA, 2143 bp, H. influenzae
  misc_feature (1954)..(1954): n = a, c, g, or t
  misc_feature (1985)..(1985): n = a, c, g, or t
  misc_feature (2101)..(2101): n = a, c, g, or t
  misc_feature (2108)..(2108): n = a, c, g, or t
  misc_feature (2134)..(2134): n = a, c, g, or t
aatagccccgccagatgtacgggatccctaatgctccagggccatattagggaattccttccagccgtaagaaaaaggtcacctccccggcatccaggttcggaacaacgggaaagcaagggaattgggttagccaataaagtcaccgttccaagaataaaattaacaggaataaccgcccaatgatggaatggatgaagcgtatattcttaacttaacccttggaatcctttagattttattgtataaaaaagaattaaaaagaaaccccaaatggacatacccaaagttgcgctaatatctgctgtcggcactgcacgaagataatgaataccgaacaaacctgcaaattgaggtaagaaatcaacaggaattaagtcgatagcattcatgatgaatacccaacagaaaattgttaatgcaagtggcgcaactacgttacgtggaccatgaaaattttctttcacgattccattaacccattccacaacaatttcaactaagcattgcatttttcctggaacgccagttgttgcttttttccctactcgagaaaaaacaaataggaaaataaccgcagcaagaatagaaaagaacaacgtatctatatgaacattccaaaatccatcccctgttttgagaaaggataaatggtggctaatgtattccgatgttgtttgtccagacataatcgatcctttgttctgaagaagaataacccaaagttaaattttattgagaataagtggaataatattattcagcactaatgccaataaaaaaccaacaaaaaacgcaataaaattgataacgaataaccatttgatggcaataatgataaaaaccatcgttaaaataaactttattgcttcagcacgataaagtgcggtcagttttgttgaaaaattttgttttctgtaaaaaatgataaatataaatgtacaaaaaggcaaaaaggcacttaaaaaaccgtagctaaaatctaccgcactttggcgttgccatccataaataagcaaataaaaaactacaagcaaaagactctcaataataatagcttttctgtagttttttttagcgtgagataaaatgcgcgacatcacttttacaaaataattttagcccgccgattatacctttgctggctttagattcaacttaaaaacacataaaaagtgttatataaatcacacttttagaaaataatttatctatttgttactttttaacgtaaaacgattaaatgtcgttcgcctataagttcaggaacagataattcaatcactttttgaatagtatattttttattcaattcattaatttcatcttcctgataaatcccttttaatgcataaaaatatccattttcttttggtaaatgatggcaccaatctgtcatatcttttagtgaagcaaaagcacggcttaatacaccatcaaatttatcttcaggttgatattcttctactcgacttaaaacgggggttacattagttagtctaagctcacgtatagcatttcgaataaaactaatacgcttacctaagctatcaaggaggacaaattgtttggaaggattaataattgccaaaggtaaaccaggcaaaccaggccctgtaccgacatcaataaaacgatcaccttgtaaataaggacttacaacaagactatctaaaatatgtttaactaacatttcttgcggatcacgaactgacgtcaaattataagctttattccatttattgagtaaattgaccagattaatcaactgctgaatttgttgatcacttatttttatatttgcttgcgcaagtaaactgactaatttggctttcatatttattatctctttgaaaaattacgctattttacttaaaagtgcggtaaatttccttaatgtttttagtaatttgatgaattatttaccgaatcaatgtccagttttacaccatanattgaatgcacctccgcataattcatttcanaggctttaattgcttctgttcaagaaccaaagaatgaatgttcgctaaaaaataagtttgttctgcttcaggaatgggaaatggcattaacttgagtaaatcttgatgaatagctnaaacttngtggaaaatgaccgcactttgcattncttcgagct

SEQ ID NO: 184 - DNA, 1908 bp, H. influenzae
  misc_feature (1462)..(1462): n = a, c, g, or t
  misc_feature (1484)..(1484): n = a, c, g, or t
  misc_feature (1897)..(1897): n = a, c, g, or t
tagaaaaacacgggggttatcgcgggaggcgaaagaaaagaagagggagggaagctggcgaggaaaaaacaccccattagaataataggatatggggtgcggcccccccaaatggggaggactctctatgtgggtgctcgaatagaaaataaatcgtttccccggtaaccaaaagggtatcgccgtcctggttcccgatttgtatacattagtattgatcacgattttcccacaaatcatcccatttgtgccaaatctattgataccataataaaaagtgcggttgaaaaacattaaattttttaaccgcacttttatctttctcgtaagttacatctgccgtaccttacaatacaaaaaggtgcaataactgcactttatcaacgcctattcaatgccgtttaatgaatagaaaactgtaaacacaactcaaaatggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttnctgtatcttacaataataaagntttactgattggcggcgaaactgatggaggtaaggctttaactagcgtcaaagcaatcagctatgatggtaaaaattaaccgtcgaaatatttatcacagaataatgcataaaaatttataataatcaaaagcgggcgaaatctatcgccgctttatacaaaataaaagtaattaaaagcaaaattacacaaattttgaccgcactttaaatgcgctataaagagctggcatttttattaatagaattaaacgatggtatttattccaccaccactactcttgttattcattgcataacaatggatttttttgccaaagattgctagttatttctgccatttttaaaggatgggttttggaattccccttcattttttgatggctttaccgcgcgtatccattctttattgtnaaaacctctat

SEQ ID NO: 185 - DNA, 1595 bp, H. influenzae
gctcggttcccctttcttgttgcaccgcctgttggcaataaatcaccttgagaagttgagcagccagtcaaaacactgcttgcggctaaaatcacgcccatcatcattaaaactttcattattgctccttaatccaagttagattgtcttgaggcttgtccgtatttcacttttcgagacatgcggtcataatcaatatcaatttgtttttcgatgtgtacagccacttctttacccggtggaacatataccgcatcaaacatttggccataacgctgacggaaccagtctgctgtttctctcaaaccgccacctaacgcttgaccaagaatatacttaccgttattacccgttaccgcaccaattactgcaccgccatcaaccactgttgttgattgagaagatgataagccttgtgcagctgctgaagcccccgttaagaagaagttggtcgttagatattccggagcatttgttctgcgttctccaggaatgcaaggcacaccatgtggatcagataaccagccaattttatcgtcagaattgtctgttgaaacaatgcggccatcgctaaacacaaaagttaagcttttcacatcaccacgaacacaagatagcgtccagtcaccgcttgctgttccagagacaattgcgccttcaatatccggcagttcaatgccatttgcaattaagttatctcgaccaataagcaatttaaacggataaggctcggttaccttattgtcaatcggcacacgcccaacaagcgcagtcatagcaacagaattagttaaagtagagttagctgcaattgtgaaaaatggtgtagcggtattaaatattgcattattacctgtactagattgcaacccatcattagattttcggatgtcattcacattgttatcgaaggttttgggaaaaccgattcctgcaccatttacaccaataccttgtagagcattcccttgtctgtctgtagttggcatatcactagggttcacccaattaattccccctcgagtttcaacctgagggccagttgttgctccgtttattggtagaggagcattgggatttgcctgggcatttccattccctacaacttgattaccagcttgtacaacctgatcttttaacgcattaatctcattaattaacgcccctgtttctgcttgtaccgcctgttgaatttgataatccgtattgtttgcttgattttttaactgctcattctcttttaccaagcgttcattttgtaaaatcacttcatcaaatcgcttattatgctctttcactttacctataagtgttcttaccgtatctttagatgtgtcaccctcaatccccattgctcgtaattcttccggtgataaatctttaaaagagatatctaaagtatcttctttcttggtttctgctgtatttgttgaactactaccggagaaaagaaatccagccatcagcgtcacgacaagagcggtaatcccaccaataacatagaacgctttatttgctttcatttgcattggccgctcccttatttgtttgaagtgcactgtttggggggaccttttttaattttttcggttaac

SEQ ID NO: 186 - DNA, 1271 bp, H. influenzae
tgtttacgattcggactcggtaccccttttacatttcatcaataaaagattgatcaagttttcaggctggtttaaggcggtcattcgatataatctggctttgcttacaccaagttgatcattatgttgctcgtgataagtattaagtgcggttaaaatttgctgcgttttttcttgtatgtaattagtattaaaacaccaatcttgataacgtacggcgtctcgctcgacgagtgctttatctaattgcaaggaagtcagttgttccgtccacattaattggcgtgctgttgtcgcattatgtttaagggtaagcgcaatacgttgcgaagcgttctctgccaatgctaaattcgctaagaaatttaaccgcacttcagtgcgtttatgacgttttggcgagttaatttccaatactcgtgcgccggcaattaaggtttttgtatcgccactgcgtaaaataagtttgtctccaaaagccaagaataatggtgaatccaatatgatttcagctaaagtgcggtcattttttgcggcattttttccctgtaataaagtgagtttacccgtagtgcgacttgcaccgtgataaatatgcactggttggttttcatttaatggtacttcagccaaaatttgtacactgatgcgatctgttggtggaagtggctcattctgcaataaccaatcacctcgtttcattgatgtgcggtctaaatcagcatttaaatttaacgctaaacgttgccccgcaataccttgttcgcttgatgtattttgtgcgtgaatcgcttttatacgaactttctgtccagtggaaaggtaaatttcatcgtttactttcactgttcctgaaaaggctgtgcctgtcacgacggtacccgccccttttacgttgaatactcggtctattgcgtaacggaaaggtttttgggtatcagataattcaggtagattagctaagtaatgacgtaattcattaattccttgtcccgtttctgctgaggtaacgaagtaattagcaccacgtaaaaaactataattttgtttaatttcttggattaacgattctatttgcgctgaatttgcacgatctgcttttgtgataataacaataattccgcggaattgaagttggcgtaatatcgcttaaagtttttttgtttgcgttcgcaccctttcatccgagggaccattaacatgcatatgcacccaccttattctgcccgctttttggcaggaatttttatgcccggcacataataagccca

SEQ ID NO: 187 - DNA, 909 bp, H. influenzae
ctgttttcgaatatcggctcggtactcttcactcaaaacatattaagggaaaacctatgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggcccctgtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcacgtatcagctgtaacttaccacgtttacacggccctgtgaatgggtaatggaaaaatcgttcaagattagaagggctatttactgg

SEQ ID NO: 188 - DNA, 2011 bp, H. influenzae
tgtatacgattcggactcggtacccctttcttctttagcctcaaaaacaggtgtagaatttaccgcactttcagcgatactttcttccactaagttacggcgcggacggcgttgattacgctcacggacattacgaacctgttcttcggttctttctgtttcgttattttcagaacgtggacgacgagaagaacgacgatcctgtgaacggcgttgattacgattaggattgcgcgaagtgcggttatttttcggtttgttttcttcagatttagtcgcaaataaacctttaattttcgcaataattttagctaacaaagagggttcatttgatttacgctcaactggcgttggggctgcttctgaaatagaaagtgcaactactgcactttcaaccgctggttgttcaataacagctgttgtttccacattacgagaaagcagtgattcttcagtattttcatcttgagcgcagtgaattttcgctaagttatagcttaattcatttacttcttcgccatcacgtaaacggaaaacactaaagtgcggtgtttccattgcttcatttggggcaacaataatatcgacattatgacgcttttcaatattactgattgctttgcgtttttcgttaagaagataagaggcaatttgtactggcacaatggtatgtacttgcttggtgttctcttttaatgcttcttcttccagcaaacgtaaaatagataaagaaagagattcattatcacgcactttgcctgttccttgacaacgagggcaaatatggtgcgaagattcgcccaatgatgggcttaaacgctgacgtgacatttctaacaaaccaaaacgagaaattcggctaatttgaatacgggcacgatctggacgaaccgcatcacgaatacgattttctacttcacgttgatggcgaattggtgtcatatcaatgaaatcaatgacaactaatccacctaagtcacgtaagcgtaattgacgcgcgatttcatctgccgcttcaaggttggtatttaatgcggtttcttcaatatcgccaccacgagtagaacgtgcggagttaatatcaatggcggttaatgcttcagttacatcaataacgattgaaccgccagaaggtaaacgcacttcacgttggaatgcggattcaatttgagattcaatttgatagtgactgaaaagtggcacttcgccttgataaagtttcacgcgattgatgaaatcaggacgcacaagtttgatatgctctttcgctttctcaaaaatttttgggctatcaatcaggatctcaccaatatcacgacgcaaataatcgcgaatagcgcgtacaatcacatcgctttcttgatgaattaaaaatggagctggacgactttgtgaagcttgtttgatcgcttcccaatgatgtaataatacttttatatcccattgtaattcttctggcgattttcccacaccagcagtacggacgattaagcctacaccttcaggcacatctaatgaacttaatgcttcttttagttcagaccttcatcgccctcttacggagagaaatcctcctgccccgcgtatattcctctttgcccctttactgtcaccttatatccacagtcgtttggcccgctctctcctcttgttttttcccttctctccctcatcgctcccctgctcgttttctttccccaccctgtttcatttaattcattactccacaatgcaatttataagaagaacgaataccaagttgctgtccgttgcttgcgacgaaccactgaggagtccggctggtgacagctgaggcgcgccagacagacctcccgccgaagtcgcgcccgtccgccctcacgccacggcacacgagcgctgccgcgaccgttcccgcgctcccgtccgctccgaccggtctctaccgccgccctacctctttctagcacactagagtcaccctgcgcgcgcccgcgccgcgaccacccatcgaacaactcccccccaccac

SEQ ID NO: 189 - DNA, 1835 bp, H. influenzae
  misc_feature (1651)..(1651): n = a, c, g, or t
ttaagatatgaaaagcgcttaatatctttggaaacgccccaggtttctcctaactaaatcagaacaggctacgttaacagtaaaccgtgatacatacaggggtgtgcgcaatcagtctatgttcaaaaggcatgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagcaattatccaacatattctcacccaattggtcgcaataaaccctgtattctagaaccagtttttgggataagcaagctatctatgaaaaactcaataagattttattcattttaaaacatctaaaatttttaccgcacttttagtctgactagcaaaagataaggtaatgacaaatcatttttaacctttctcattgagcaaaatctattcaaaacataaccgttctttaaaaatagcctctatgtaatcttaagccaccagtatttttattcttgatatttagtgtttctatgcgacaatctttgcggttatttactttaaaaatatgttttactaaatggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgagagtgggacaagattttcgtttattactgggtaatgggagtaatgtttcgaggaaattggcgtgagctctacaagcanagtgcggggaaaaaatcctttgattattacaagagaaaatggattttttaactgagggattaaaattagcacttggtcgttcccaaactttagacaggatttttgagcgggttgaggtccttacaacccacttaacgtttttctgaaacaacatgggggttattgtttgttctcaaggaaaggc

SEQ ID NO: 190 - DNA, 2428 bp, H. influenzae
tgggtaagggtaaaagggaagggaaataaggcggtgggaaggaggggcaagggaattggggaggggaagggggggaaaaacggttggaaagggagggatagaaaggggagccaataattggggggaaaaaagggcggaaatagtgaacaagcgggtgaaaatgcgggtgtaaaagcaggaaataaaggtgcagaaacagcatggacgcgcttgaaatggatatgttattcaacaaaatggggcggcataaatcatgacagaacaaaaacaagtgaaaaagccttctgctcgtcgtcgtgcgcgtgagtgtactgttcaagccttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtgaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcacttaggcgatagcgcggcaggtttaacacaaattttatggggcaaaagtgcggttgattctgatgatgtttttttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaatgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaataccagtttggggcattttaagcataacgcttggtatcgctttttggggaatgcttctatgttggattggccggggtttgttcttaccattccaccttacatg

SEQ ID NO: 191 - DNA, 1260 bp, H. influenzae
ctttatcgaattcggactcggtacccaaaaatgcttatcaacaaagaacttgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaaggttgtaaactaactgttgagttatctctaacattgttaaagtgcatacactatatttttaatattagtttgaaattttttaaaaaatttctgtttcttatttgacgaacgcgcattttatgactagaattgcaccctattttattcactcttaattgtatttaggtaaattaaaatgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataatcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagataaaaataaggactgggtaccgagtccgaattcgatacca

SEQ ID NO: 192 - DNA, 1178 bp, H. influenzae
agataagagaatgaacacccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcgtagttaaaagcaaataaaaaagtgcggtgaaaatcaaccgcacttctatctagtatctagattatatttcaattaattactcgtcgctttacgtctagcaataactgcatcagaaagttgttgcaataatctttcagaatcttcccatccaatgcacgcatccgtaatactttgtccataagtctgcgctttgccatcaactaaatcttgacgaccttccactaaatggctttccaccattacgccaaagatttgtttagaaccaaatgcaatctgattacatacgtcttggcaaacatccatttgctttttatattgtttactgctgtttgcatggctaaaatcaaccataacgtgtggaatacgccctgttttttcaatatcagcacaaactttttctacatcttcagcactatagttaggacctttatctccacctcgtaaaataatatggcaatcttcattcccttttgtagaaacaattgcagaatgaccaaatttagtgacagataagaaatagtggggagcttccgccgcaccaattgcatctaaagcgactttcacaccaccattagtggcatttttaaacccaacagcacaagataaacctgaagccaactcacgatgaacttgtgattctgttgttctagccccaatcgccccccagctcataaaatctgccaaatactgaggtgtaatcatatctaaaaactcgcccgctgcaggcaca

SEQ ID NO: 193 - DNA, 2375 bp, H. influenzae
ccgtaatttctggctttggcacccttattaagtatagcaagctagcccagcttacgaggggaaaagagaatgggcctctcaaagccagcatgaagaaaaacgtcgaatgctcgctatcgatacccccctttgggcagaagctggtcgatcggagatatctaacccaagtttcgctcaccaaatggcaatttagtgcccatccttatctacatgttggacagagtgaagtcttgtggaaatatcatgcgactttcaatctgcatttaatggataagcccaatattcgcattggtacccctgtcatattgccagatgccgatacagaaataatcagtgtagcaaatgacaccattcaactttggagttgatatgcgcgacgcgccatcaaaagcatcttacacatcaggaatattcgccttcttagttgcacgcattgccgatatgttctcaaatgtaaattgggctgatgtcgcatcgattacaggtattgtgattggtgtcgccacctgtcttgtaaattggtattacaagaacaaagattttgaattaaaagaaaaagaactcaaacaacggatccatcatcatgattaaacgttccgccaaatacatatgcgccatatccgccgttgttggacatgtgattgcctatcatggaaatgaaattcgaacatccgaaaaaggcttgttactgattggcaatgcagaaggttgtatgaaaaagccctatcaatgccctgccgatgttttaacagtcggcataggcataaccgatgccgttgaaaaaattgaccgcaataaaatttacaccttgcaagaaattgccgaattatacgtaaaaggcattaaacaatcagaaaaatgcgttaatcaatatgccaacgggaaaaccatgccacaaggtgcatttgatgccctcgtctccatcacctttaacgtaggatgcggcaaattaaaaaatagctcactttttaaaatggcacgccaaggctacagcaaagccatgtgcggtcaattcgaacgttggatttatgcagcaggaaaaccgctaaaaggattaattgaacgccgtcaaaaggagaaaaacctatgtttaatttcttaaccgccaaagaacgaggcattttccttatcgggccaatactgcttgtactcctcattgtttttctgggatttaaggctaattattggcgaaaagaaatgctcaaagaagaacagctaaaactgaaatggcaaaacgcttacattgagttaaatcatagcgttcaaaattttgccgaacagcaagcacagctaatccaagccgtaaacaacctcaaagcaaaccaaaatcaacaaacacaggatttaaaaaatgtacttaaatcaaaccaagattgggctaaccgccctttgcctgatgatgttaaacgcgtgctcaactcagcaggaagtcattaaatcaccgattctttgtccacaaaccacagagtgcagtgcgtattcgccacaaattcgcaccaatggcgaattagccgaagcctatttacagacacaacaccaccttgatttgtgcattatcgagaactcaagtttaaaaaaatgcatagatgaatttaataaaaaggaacagccatgacagatcaattcgaccgagcacaacagcttgaagaaatgcaacgcgaaatcgccctcaaaaaacaccgcacttttaaagcagtaagtcgcctttattgtgaagattgtgatgcccccatcccagaaaagcgcagacaaatgattcaaggcgtaacacgttgcgtgacttgccaacaaagatttgaaatacaacaacggaatttcagaaaatgagaagaaccacacttttccttgctatcgctgccgcattgccttgtttagcaaatacctacaccgtgccatttagagatggtccatttgtaaatattcaaattatcctgacggaagaataacagaagtatgcattcatcaagtaggctatttgatgacggacactggacatttgattgttgccgtagataaagacaaccgaccattaatttgcagagatacgcaaaatgaaaaagcccaaccaactgcgcaaaatccttgaacaaagccatcccgattttgtaaaaaatcccgaccatctacaactttatgtgggacgggtggcaaaatcgtcgcaacgggagccgcatcatttagttttgaatatcgttaccactcaaggttgtagtgactgattatgcaggcgatattgccaccttgatgtggcaatgatggcttacctccgcacaaatcaacctgaaatattagaaaaccacaaattcgagagaacgcatttaatccagatgatacacataacacaccgagaattagtttgaatccactactgaccg

SEQ ID NO: 194 - DNA, 1097 bp, H. influenzae
atatcagcctcggttcccatttttgacaaatagagatttttatggcaactccagtcgtcgcccttgttggtcgcccgaatgtgggaaaatccacattatttaatcgccttactcgtacgagagatgcgttagtcgctgattttccaggtttaactcgtgatagaaaatatggtcacgcacatattgctggctatgattttattgttattgatactggcggtattgatggaacggaagagggcgtagaagaaaaaatggcggagcaatctttgcttgctattgatgaagccgacattgttcttttccttgtggatgcgcgagcaggtttaacggcagctgatattggtattgctaattatttacgccaacgtcaaaacaaaattactgtggtggtggcaaataaaaccgatggtattgatgcggattctcattgtgctgaattttatcagttaggtttaggagaaattgagcaaattgcagcctcacaaggtcgtggtgttactcaattaatggaacaagtacttgcgccttttgcggaaaaaatggaaaacgccgatgaaaatgaccgcacttctgaggaagaacaagacgaatgggaacaagaattcgattttgattcagaagaagatacggcattaattgatgatgcgttagacgaagaacttgaagaagaacaagataaaaatatcaaaatagccattgtaggtcgtccaaatgtgggtaaatctactttaaccaatcgtattttaggcgaagatcgtgtagtggtttttgatatgccaggtacgacacgtgacagtatttatattccaatggagcgtgatggacagcaatataccttgattgatacggctggtgtgcgtaagcgtggtaaagggcatttggcaggggaaaattctctgggataaaacttgcagcgattcagatgctaagtggtttgtgactatgacgcagaaagattttctgaacagattatcttgctcgctttatttaaagcggccgtcttggggaccgccgaataagggatggttaaaacaatgggaaaaaccggaacctacctgacccgttaaaattatgtttgctggggctttattaag

SEQ ID NO: 195 - DNA, 1489 bp, H. influenzae
  misc_feature (1441)..(1441): n = a, c, g, or t
aacaggggcggcgcgagaacaaagacgaacagcgcgacccggacgggagagaataagcggacgcgatgagccggtgcaaacaacagcgagagaggcggggacgcgtcaccacacagccgcgaaaggaaagacgcggacggcccgaagaaccacatcgggggggaacgaaaaatcaaaacggcgacaggaattgagaccggcgaaaccgcagacaaaacggaggagaaacgggggcgaaaaaaaaaaaaaacgcgcgaaccgcaaacagcatggaccgcaaagggaggacaaacaagatggggtacggacgcgcgcagtcgggagcaaaaaccgaaaccgggcgccgccagcgagaatgggaaaacattcgggggaaatattgaaaaagttggggaggcataatatgcctgaagctgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaaaattgaaattagcaacgatactcgcgttatccgccatagaaccccagcacgtatcagtcactggatgttggttatttgcttttattatgacgatggttncactggtgttgctttttatgggtaccgagtctgatattcgtataccag

SEQ ID NO: 196 - DNA, 1197 bp, H. influenzae
  misc_feature (1070)..(1070): n = a, c, g, or t
  misc_feature (1105)..(1105): n = a, c, g, or t
  misc_feature (1142)..(1142): n = a, c, g, or t
gccagattgctgcctgcaggtcgactcttggaggaccccgtcgtattattggacttggtttagcaatgctgacaagaattttacttttaatgtcacttgcttggattatgaaacttactgcaccattatttactctgtttaatcaagcaatttctgggcgtgatttgattttattaatcggaggtttattcctgattataaaaagctttggggaaattaaagaggcaataaatcatcaagaacaccataattctgaaagcaaaaacaaagtgagttattttggcgtattaattcaaattgcagtgctagatattgttttttctttagattctgtgattacagcagtaggtatggcaagccaccttcctgtgatgattttggcgattattattgccgttggcgtgatgatgtttgcagcaaaaccaatcggcgctttcgtagatacgcatccaaccttgaaaattctagctttagccttcttggttttagttggaattagtttaattgcagaaagtttagatattcacatcccgaaaggttacatctattttgcaatgggattctctgttgtggtcgaaatgatcaatattcgaatgagaagattgataaaataaattggaagtgcggtcgataaaaataatgttttttatgaccgcactttttcttttacttattgaaatacactttttttagtgccatctctaaaccgcgaaattcagctagaccttttaaccgaccaatggcagagtagccagggttggtttttttacgtaagtcatccaacatttgatgcccatgatctgggcgcattgggattaaacgcgtttctccttgatttaatcgacgatattcttcatttaataaggcttttaccacattaaacatatctacgtctccttctagatgagctgcttcatggaaggttagtggattatcttcacgttgagtagaacgtaaatgtgcgaagtaaatacgatctgcaaattgttctgtcatttttacgagatcattatcggagcgtacgccataagaacccgtacacattgtaaaaccatttgctggtaatgggntgagtttctaccaaccattgcatatcttcaatagntgaaactatgcgcggtaagcctaagattgggcgtggnaggatcatctggatgaatcgccattttgattcctacttcttggggcacaggtacg

SEQ ID NO: 197 - DNA, 1605 bp, H. influenzae
  misc_feature (1578)..(1578): n = a, c, g, or t
ttattcggtaatctcgcttgagacggatgtatcgttaaaaccgctggtgtagatgaatctattttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccaggggattccctagagtncgacctggcaggcatgccaagtctggc

SEQ ID NO: 198 - DNA, 1092 bp, H. influenzae
caggtcgactctagagatccccgtggcagggcaacaggaaaagtcaatgaagaacaaaaaccaagttatgatccaacttgttatctttgtccgagtaataagcgtattacaggggaattaaatccagattatcgtaaaccttatgtatttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactacctatcttgtccggtcccctttttacctttagcaaagagtggtgcagatccagtatataattaatataagggatggaaatattacccccatcccaaatgcttaccaatttttcatgaacccttac

SEQ ID NO: 199 - DNA, 2461 bp, H. influenzae
  misc_feature (889)..(889): n = a, c, g, or t
ctggtatacgaatatcggcctcggtacccctcaatgagcgtaaacgactagcaagcctaatagagtacattaccagttggggcgtgcaaatggcgtgagatttaacgatagatgggggttttaaatgaaacgcttaaacgatgatgagattttggagttaaaaattgtacttttgattgcggcagtttgggtaatgtttaatatggtgtttggctaatggcgaaagagtataaatgcaaagtttgtggcaaagcgtttgtaaaaacctttagctcaacacaaaaagtttgctcgcctgaatgtgcgattaaattagtccgagaacaatcaagaaaaaggcaaaagaaagcggaaaaacaagaacagatagagcgtaaaaaaagattactagatggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagattgatggttgcaacagagaggctatgtataaagctgattgcgtttgccaaatgcactattttagatttatgagaaacggaacttatgatcttcttccgaaaccaatccgaanatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgattaagcattacaaggcaaaaattaaggagcttacgtgaatattgatgtgatttcagttgaatttggttattgggctacacctcgttatgagactgaatttccacgtgtagccgcagggtttgcagagatgaaatgtgatgctcgttatgctgaaaaatatcgtatgcgtcctataagcgatgaattaggcatggaaattgatggctaccttggtgtaattagaaaagtccccccagaccttatgatgtattcgttctgacttatatcaagagatgggaaaaacaaagaaattggcgatatttacatatttcacggcgtgaatatttcaatcgattgaaaacggtaaaaacatcactttattgctattatcaacagaaggcaagcaatgtttatttattgcctgaaaagtgcggtctattttgaccgcatttatttcaagggtaggtattctttctattcttgtccttcctgaagtgtgagtttggggtgtatcttatctaacatttcataaaaattatctttatctttagatagctttaaaagtgtaacgatagaagataaatgttcacgcaatttagggtgccctacgtcttccgttaaaaactggtgtaattttactttttttgcttgtttacttgccgattttttgagttctggtaataactctggagcgagtcgggcatacacggcgttgtttgtaatatgcccgaagaattgtggaaattgattattatttttcggagggaattgaacgccatataaacgacataattccttgtaatagtctaaaggaaaggttttaacccaaggttgtaattcttttgcgacaaaggcttcaaaaatttttgcgagtgcgtctttggctcgtgcatcttgatagccggtgacttcatccactaatgccacaatgcccactttggctaaagagcggattagaatttctgctttttgggcggtgttttgttgcttaccaaccaacgcccttcttcacgtgctcgtagataaatatcacacacgacaggtaaaatagtcgca

SEQ ID NO: 200 - DNA, 1920 bp, H. influenzae
taatatttggtataaaaacgaggattttgcatctaattgaggattaaaattcatcggtagccagcgtaaatagctattaagaggcgcaacttcgttgccttcttttaccggcactaaattattactgagtaaaaccgttcttaattctcttgagcgaatgcgtagctcttgatcgtctttccctcttacatagaaaaccatgccagcttgataaagcttgtgtccgtcttttaaatattccgttactgtgagggcatcttgttttaaatagatagactcatagttattaccgacagctcgactacttaatttgtctaaatgcgcctgtaatttatcttgaggatgaatgactacagtgatagccataatggttgattccggcaataaatcaaatagtgcattaatattacgacctcgagtgacttcgccatgtcatgtggccaacatccggctgcttacgaatattatcaactacaatgacttcgtgaggttgctcattaaaataccaatagccatttttactttccggtggcgtaaaaaagagattttcactaaaatcttggtcttgtaatggtagagcagattcatccttagagagtgataaaagatcatagcaagctttatcatcgagtccgttaaaatagcgtgatggatttggattaaaccattctaataaccaacgatgaatttgtgtttcattttggcgttccatggttaatccagctgtgataaaagcactttgaacacgatcacaagctgtatttaatttctcgattgtatctgtctcattatttccagcataacgataaataaccatgcgtgttttacgcacttttccagcccatgccgtatttgttacccggtcatcaacaaaaagcccacctggtttacctactgcttttaagtgacgctccatttcaccaagccactgttctgtaaactcactaccgctcgcttcaggtgaagtggttttaatgtactgtctcagattctcaacataaccgcttaaatccttgtcatcctggcaatagaattgtacaacgtaagggttggtatcaagttcatcgaaactatcctgtaaggcatctttaaccaatgtgcgaacgcgattaagatagtcgctgcttcttccctcagttcctataggcttaatatcaaataccgcacctgcacttttagcatcatcaaaaagcattacgccttcttcttccaaatattccgcataaggaagattggagataaaagagggatcgcgcccataaagcattttaacatgttgctctctggtcatttttctattacgcataacaggagtgatttcaatcgtctcttctacgttattggtatcatcctgctgtgcttcttccggtgcaatggatgttaggataggttcctttttaggttgaggcttatcaccttttttagcagggaagaaagcctctaacacgtcttggaataaagccatcggttcttacctcaactagtacatttcttgaacgctcacccggtctgtgcatattgcacaccgtccatattaatggaattacctgagaaattaaccctggtacatggcattttgttctttgaagaatatcatgtaaaggtccggatttaaccctaacctaccttatatcatgggtcttggataaacaaggggataaacatattttaactctcgtgtttctgtgggtcaggtgttaagttttggtggtcaacaatatatgaaatgtaatttgttgcattatttaataacggctttccgtggcctcacaataattaataactgtaatcttacgcgcctcttattgaattcattacaggtgtggcccccctgtgtgaatatacctccttgaatggtgagacacctatactaaatttcggtgttttaaacactctcctcctttatcattttttttgtct

SEQ ID NO: 201 - DNA, 1960 bp, H. influenzae
gttttcggatatcggctcggtacccctaacttggtttcatctccacaaactttagatgaagatggcgatgagttagatgtgttattaatcactcgccaaccattagcaacaggtgtattccttgaggctaaagtaattggtgtcatgaaatttgttgatgatggcgaagtggatgataaaatcgtttgtgttcctgcagatgatcgtgatacaggaaatgcctacaattcattagcagatttaccggcaaacttaattaaacaaattgagttccatttcaataactataaagcgcttaagaaacctggctcaacgaaagtgacccattggggcgatgtagaagaagcgaaagaagtgattcgtgagtctattaaacgttggaatgagcgttaattaaagacgtttgattgtaaaagtccctgattctttgagtcggggattttttatatgagtttcagagatttagataataaaaaaacacctttcggtgcttactttatttttaaagtggtgggtcgtgaaggattcgaaccttcgaccaacggattaaaagtccgctgctctaccgactgagctaacgacccaattagatgattttaaaataaattttcaaatcttttgattggtgtttaaatggtgcccgaagccagacttgaactggcacgcctcgaaaggcgagggattttaaatcccttgtgtctaccgattccaccactcgggcaaattggagcgggaaacgaggctcgaactcgcgaccccgaccttggcaaggtcgtgctctaccaactgagctattcccgcatttatcactaatcagcactgctacgtgacaacggggcgtattttacggatttatatattgctgtcaaacgaaaaaaataaaaaatattttatttgattaaaaataactcaaatatagatggttatcataaaaaataactgtgttttatttaaatttataattgaatattatctagcaagcttccttttgctacttgtaaatattggatcattgaccatatagttaaaatagcggcgatataaagtaagataattgctgctatttccatatagttgttataacgccataataatccgcctagtgctaacatttgcgctgtggttttccattttccccaccaagagactgcgactttgctacgttccccaagctctgccatccattcacgtaatgcggagatgataatttcacgagaaatcataataatggcaggaatggttatccaaaatgtatgttgatgttcgacaattaaaactagtgcagccactaccattactttatcagcaacaggatcaagaaatgcaccaaagcgcgtggtctgtttccatttacgagctagatagccatctagccagtcagtgacacctgcaataaaaaaaatcagtgttgtgatgaaaggagatgattcaatgggtaaataaaatgcaatcacgaaaaaaggaatcaaaatgactcgaaagatcgttaggaaaattgggatattgaatttcatagaaatgaaccgctcttggtgttagagatatgcctattctaaagtatctaagaatataaaaaaagccacattatgtggctttcttgtaaataattacggattaaagtttatcagcgttttgttttaagtattttgcaacaccttcagggttatctttcatcccttctttacctttttcccattgagcagggcaaacttcaccgtgatcttcatgggattgtaatgcatcaaccatacgtaacatttcatcgatattacgacctaatggaagatcgtttactacttggtgacgaacacgccatttttgtcgataagaatggaacgcgaatgcaacgcctgctttggttgttcaataccgatgctggagcaattccggtttaacgctgccctatgcctttgtacttgccgacccaccttttagccgggggggtacccctccattggag

SEQ ID NO: 202 - DNA, 1080 bp, H. influenzae
ttagtgaaccacgccattagctagatgaagtacgtgcaggtaaagaagctgttgttgctaaattaactggcggtttagcaggaatggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggcttaaattcccttgggctgcatcaggccgcgcgattgcatctgaatgttcagaaggtatgacgaagttaatctttgataaagatacgcatcgtatactgggcggtgcaatcgtaggttctaatgtggggaattataaggcgaaaatgggtaaccgagcttcgatattcgtataacag

SEQ ID NO: 203 - DNA, 1598 bp, H. influenzae
caaatttggtgttaaattttcaacgaatataacgcaattgaaccatttcataaaaaaagtcctatttttaaataagtttgttcatttccgaaaaacggttttcccgcttaagaaatttggccagatttgggacgcgattaaacctgtttaacatctaatttcgtttcagtctcagcaggtaatcccaccaattcacgtaaataattgacgttttcaagatccatttcttcccagcccccacgaggcaaacctttcatcagtttgatatttccataacgaatacgaatcaagcggctaacttgaatcccttgagattcccacaaacgacgaacctcacggttacgtccttccatcaaggttacgtcataccattggttaatacccacaccgcctgtaaatttaatttctttaaaattagcaggaccatcttcaagctgaacgcctttacgtaaacgcgctaacatcgcatcatcaacttgaccaaatacacgcacagaatattcacgttcaacttcacggcttgggtgcattaaacgatttgctaattcgccatcagtggtaaaaagcaataaacctgatgtattaatatctaaacgccccaccgcaatccaacgagatcccgttaaacgcggcaaacgatcaaacacggtcgcacgcccttctgggtcgctacgtgtacagagttcgccttcaggtttgtaatacattaatacacggcaaatttctttttgtgcgtggctaagattaatgatttgaccatcaatacgcactttcacgccagaatgtacgtcaatacgatcgcctaaagtcgcaattttaccctctacgctcactctgcctgcggcaatcatcgtttcaatttcacgacgagagccttgtccagcacgcgctaaaactttctgtaatttttcgccctctgctttcggttgattcgaggctcttacaacaggtttcgcttttggcttagataaaaatttgttgtcagaattaaccgcactttttttcgtatttgctgtttctatgcgagcagtacgagatactgaacgtctgtcatttttagctgaaaaatcacgtttctttgctgaatctttggaaaagtgcggttgtctttgagtttgtttttgactaggtttcattgttttccttgaataatggaaaggtcgctttcacaagcgtctataggttaaataaaaggagcagtacttccacttccttcgcgtaaaatcactggcgattcttccgttaaatctaccactgttgtaggctcttgccctaaatatccaccatgaataattaaatccacttgatgttccaaacgatcacgaatttcttcaggatcggattgcgtagtatgttcttcattcggcaacattaacgaacaagataaaatcggctcgcctaaggctgaaagcaaatctaaagcaattttattatctggtacgcgtaaaccaatggttttacgtttttgatgtcattaaagggcgagggtaatctttcgttgctgtaagaataaagtataacgccctggcgtattatttttaatcaacgatagcgggattatttaccgtgcatagttgaaagttcgacaaacgctaccc

SEQ ID NO: 204 - DNA, 1282 bp, H. influenzae
  misc_feature (1001)..(1001): n = a, c, g, or t
catttagaatctacaaaacggactaaatcaggtaacatttgattcaagttatgcataaattgttgataggttgcttgtttttgactaatgtctgtgagttgcgattcccaatgagccgtcatatctggttgggtggcaatatctggtaatgcctgaattaaaattcttccagtttctgtactgtgaatatttcgcccttttttagttaaaaaactgcgtttaaaaagtaattcaatgatgccagcacgagtagcctctgtacccaatccatcggtttctcgcaggatttttttgagttctttatcctgcacaaatcgcgcaatgcccgtcattgctgaaagcaaggttgcatcggtgaaaggctttggcggctgagtttttttactcatcacttctcctcgttcacaatgcaaaatttgacctttctttactattggtaataagggttcttgattttctgtgtcgtcttctttgcctaacaattctttccacccagccgtttgtaaatttcgcgcttgggctataaaagtaccgccagcgatatttaatgtgattttacttttacgatattctgcgtcaggacaaaattgcattaaatattggcgagcgataaggctgtaaatattacgttcttcttgtgttagatttactggacgatttttggcagtaggaatgattgcgtggtgagcctctacttttttatcattccaacagcgatttctctgttcagttgaaatgacatttggtaagcgttgataagcttcacaatgggttgaaattgcatttaatacattgtggcgttcggcaaaatgttcttcgggtaaatagcgacaatcagaacgcggataagtaattaaacgatgagtttcatacaggcgttggcatgcatctaatacggcttgagcggacataccgaatcgctttgctgcatcaatttgtaacgcagaaagtgaataaggcaagggcgccgtttctttttcacgaacgtctttgtattcggngacttctgctggttgatttgtaatacgttttacaacgttttctgctaatcctttagagagcaccctgccgtcatcatcttggtaatcctcgcaagctttgctaggttgccataaggcacttgaaagtgcggttgatttttctggagtttttcttctttgctctctgggataacccaagcctgtactttaaagaggcctttggcctggaaagctcaaattctaaatctgacggacattaaacctaacacagggggttgcctccttccacagaaaacccccat

SEQ ID NO: 205 - DNA, 1614 bp, H. influenzae
  misc_feature (1343)..(1343): n = a, c, g, or t
  misc_feature (1579)..(1579): n = a, c, g, or t
atttatacgattcggactcggtacccgctttataattttttcatctggattcctaaatttgtgaattactggcaaactcaacaaaacttacctgtaatcatagaaaatttttaaaaacatcttaaattttgaccgcactttatcacaaagtgcggtcagcttttatgatgaattgattaactaaaatcagccaccaaagtcatctaataaaatgttttcatcttcaacaccaagatctttcaacattttaattacagctgcattcatcactggaggcccacacatatagtattcacagtcttctggtgcttcatgatttttcaagtagttttcataaagtacattgtgaataaagcctgtatagccagtccaattatcttcaggcaatgcatctgaaagtgccacgtgccatacaaagtttggattttcagcttgtaattggtcaaagtcttcttgatagaatatttcacgtttagaacgtgcaccataccagaacgacattttacgtttagaatgtaaacgttttaattggtcgaagatatgtgaacgcattggagccatacccgcaccaccaccgataaataccatttctgcattagtttctttcgcgaagaattcaccaaatggaccagaaattgtgactttatctcctgcttttaatgaccaaatgtaagaagacatttgacctggaggcgcatcaggttggcgtggtggtggagtcgcaatacgaacgttaagcataatgatacctttctcttcagggtatgaagccattgagtaagcacggataatatgctcgtccactttagagacataacgccataaatcgtatttatcccagtcttcgtggtattcttcaggaatatcgaaatctttatagttcaccacatgtggctcagcttcgatttggatataaccacctgcgcggaaaggcacttcctcgccttcagggatcgctaatttaagttctttaataaaagttgctttgttatcgttagaaataacagtacattcccattttttcacgccgaagatttcttctggaagttcaacttccatattaccttttacattaacttgacaagctagacgataaccttcttttgcttcacgtttgttaatgtgagaaagttcggttggaagaatttctccaccgccatttttcactttaacaatacattgaccacaagagccaccgccaccgcaagcagaagacacgaaaatacctttacttgctaaagcccctaataatttgccacctgcaggtaatgtgatcgctttttcaggatcgtcattgatgtcgatagtaatatcaccagaatcgactaattttgatttcgcanataagatgattgccactaacactaatacaataaccgtgaatgcggcaataccgagtggcagaattactggatcgctcattgattacactcctttatattgaataccagagaaagacataaagcctagtgccattaaaccacagagattaagggtatacctaaaccttttatccagcagaatatcagcgtatttcatttttttccgttagccaagcagcgctacaatcgcttacatnccacctaacctgagccgaaccctaccgatagattc

SEQ ID NO: 206 - DNA, 1237 bp, H. influenzae
aaaaaaaaaaatggaagaaaaaaggcaggtggggggcaatataaacatataggtcggaatatagtcatcaaatccatccattggtggttcagcctgaggtgcagattgttgtggagctgggcgagatgattgataactattaccattgttagtttgacgagcttggtaagaagattgtggcgaaccgcccatatcattaccagaaccacttgcgttttgattacgtccaccaagcatttgcattacatcgccttgaatttctgtggcgtaacgatcttgaccgttttgatcttgccatttacgcgtttttaaacgaccctccacatatacttgagaacctttacgtaaatattcgccgcaaatctctgcttgacgacgatagaatacaatgcggtgccattctgttacttcacggcgttcgccagtattacggtcgttccagctttcactggttgctacgctgatatttgcaacggcatcgccgtttggcatagtacgaatttcaggatcattacctaaatgacctacaataatgactttattaattccagccataaaaaacctcattttttatctaaaaaagtgcggttattttgcctgaaattttttaaaagatctatatattttaactggatatttgcacagatattaaaatatgcgataatgatcgcaaaatttacatttatttcatacttttgagttattttatggaaaatatcgatattcgcggggctagaacccataatctgaaaaatattaatttaactattccacgcaataaacttgtggtgattactgggctttcaggttcgggaaaatcctctttagcctttgatacactttatgcggaagggcaacgccgctatgttgaatctctttcggcgtatgcgcgtcaatttttgtctttaatggaaaagcctgatgtggattctattgaagggctttcccctgcaatttccattgaacaaaaatctacctcacacaatccacgttctacagtgggaacaattacggaaatttacgattatttacgtttattgtttgcacgagtaggggagccgcgttgtcccgatcataatgttccattaacggcacaaacaattagtcaaatggtgggataagtattaagtttgccagaagacagtaagaagatgttacttgcgccagttgtcaaaaatcgaaaggcgaacatctcagatttagaaaaattgctgcgccaggtatattcgtgcgcgga

SEQ ID NO: 207 - DNA, 1708 bp, H. influenzae
  misc_feature (1696)..(1696): n = a, c, g, or t
aagatgatgaacctgttatccgcttacttaatcagatttttgaatctgccttacaaaaaaatgcctctgatattcatttagaaaccttggctgatcagtttcaagtgcggtttagaattgatggtgttttacaaccacaacccttaataagcaaaatattcgccaatcgtattatttcacgcttaaaattactggctaaattagatattagtgaaaatcgacttccacaagatggacgatttcaatttaaaaccactttttccgatattcttgattttcgcctttcaaccttaccaacccattggggcgaaaaaatcgtgttgcgagcgcaacaaaataaacctgtagaacttagctttgctgaactgggtatgaccgaaaatcagcaacaagcatttcaacgctcacttagccagccacaaggattaattttagtaaccggccccacaggaagtgggaaaagtatctcgctttacaccgcacttcagtggctaaatacgcctgataaacatattatgaccgctgaagatcccattgaaattgaacttgatggtattattcaaagccaaattaatccgcagattggattagattttagccgtctattgcgtgcttttttacgtcaagatcccgacatcattatgctaggtgaaattcgagatgaagaaagtgcaaggattgcactacgtgccgctcaaacgggacatttggtgctttcaactttacataccaatgatgcaatatctgccatttctcgcttacaacaactcggtattcaacaacatgaaattgaaaacagtttactactcgtcattgcacagcgtcttgtacgaaaaatctgtccaaagtgcggtggaaatttaataaattcttgtgattgccatcaaggttatcgagggcgaatcggcgtgtatcaatttctacattggcaacagaatggctatcaaacggattttgagaatttacgagagagtggtttggaaaaagttagccaaggcataacagatgagaaagaaattgaacgtgtgttaggtaaaaactcatgactaaaaaactcttttattatcaaggtagtaacgcattaaatcagaaacaaaaaggctcaattattgcggatacgaaacaacaagcgcactttcagttaataagccgcgggcttactcacatcaaattacaacaaaactggcaatttggggcaaaacccaaaaattcagaaatcagtgaattactcaatcaattagcgacattgctacagtccgtaattccgttaaaaaacagcctacaaattttgcaacaaaattgtactcaaattatgctcaacaaatggcttgaacgactgcttcaatccattgaatctggcttagcattctcacaagccattgaacaacaaggaaaatatctcacacaacaagaaattcaactgattcaagtgggagaaatgacaggaaaacttgccgtagtttgtaaaaaaatagccacgcaccgtagtcaatctttggctttatcacgcacatacagaaaattatgttatatccctcaatggtattggggaatttctctattattgacactcgcattactgctttttatcgcgcctcaatttgctgaatgtacagtggtcataatgcggagttaccaacaataaccgcaatattgctctcaatatctaatttccttaagcacaatattggcattntgctattgttca

SEQ ID NO: 208 - DNA, 1489 bp, H. influenzae
  misc_feature (1219)..(1219): n = a, c, g, or t
  misc_feature (1312)..(1312): n = a, c, g, or t
atcccctttacgcaatatagattttatctactttgtagtagaatgcggaccttttatttttagaatcaaaaactatgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggttggtttaanttatgtgacagcttaaataacgttaaaatgttaccagaaagcatcaattcattattgaaacctttcctctttcatctgaaggatgggctgggntggttcccactttaaaatggtagtgcagcaattttatgggaaaagctgctaaaaccattttaatctcaaaagggttattttacacccttgcccgaaaatcgccttagggggaaaatagggcagggtgaaaatttaccgctttttaaaaaaattattacaggccttacctatttttta

SEQ ID NO: 209 - DNA, 1514 bp, H. influenzae
agtctaatgggtagaaaaagattactgcagcttttccagcaatgtgttttttaaagttgaagttatcaacgatttcgccattgcttaatacagcagatgaagtaaaatctggtgcttgacgggttactaataccatagtcataattcctatataaagttaagttaaagttttgccacacaaaatagcggtgcgattctatttgaaacgccgacattttatactcgattttatctattaaagcaattaatcttatctaaaataaggtggaaatatgcaacaacacaatctctcaacaacatttgtccatgcagggcgtcaaaaacgtttttcacaaggatcggtaaaccctgttttacagcgagcttcttcattactatttgacagtattgaagataaaaaacacgctactcaacgtagagcaaaaggcgaattattttatggcagaagagggacgctaacacattttgctttacaagatttaatgtgcgaaatggaggggggggcaggttgttatctttatccttgtggtacagcagcagtaactaattcgattctttcttttgttaaaactggcgaccatgtgttaatgagtggtgcagcttacgagccaacccaatatttctgtaatattgtgctgaaaaaaatgcagatcgatataacttattacgatcctcttattggtgcggatattgcaacgcttattcaaccgaatacaaaagtacttttcttagaagcaccgagttctattacaatggaaattcccgatattccgactattgtgaaggctgcaagaaaggtgaaccctaatattgtgattatgattgataatacttggtcggcaggtgttctatttaaagcgttagagcatgatattgatatttctattcaggcgggtacgaaatatttagtgggtcattcagatattatgattggtactgccgttgcgaatgcgcgaacttgggatcaacttagagaacattcctatttaatggggcaaatggttgatgcagattctgcttatacgactgctcgtggtatccgtacattgggggtacgattaaaacaacatcaggaaagcagtattaaagtggcaaaatggttgagtgagcaaccagaagtaaaaactgtgtaccatccagctttaccaagttgccctggtcatgaattctttttacgtgattttagtggaagcagtggtttattttcttttgaattaacccagcgattaacttcagagcaagtatcaaaatttatggatcattttcaactgttcgctatggcttattcatggggaggatttgagtctctaattctttgtaatcaaccagaagaaattgcacatattcgtccaaatattaaacgtaatcttacaggttcattaattcgtgtgcatattggttttgaaaatgtggatgaactaattgcagatttgaaagctggttttgagcgaattgcttaaaagtgcggataaaaaaatgcctgtttacgggtaccgagtcgatatcgtataaat

SEQ ID NO: 210 - DNA, 1728 bp, H. influenzae
  misc_feature (1395)..(1395): n = a, c, g, or t
aaacctctcctaaagtgtgccacgcgtccattttataaagaaaaaacgcaggttacccttgggataagaagccaccacataaagcggatttaccaagatgtgtatcaaagtgttggatcccaccatcaaaggatgggttccattcctcgccttggggtgccaaatatggtcgctcgtattcggggcagatatcaatttgagttcaattgcaggtacttatccttatgcgggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtaaacattaatcgtattgaagtaatgccaaccgctcaatcttttgcaggaatgagcgtttcaaaagaaaaataaaataataggaaaaaatatgtcagacacacttcttaacccttattttggcgaatttggcggaatgtatgtacccgaaattttagtgcctgttttgaagcaattagaacaagcctttgtggaggctcaaaatgatcctacattccaagcagaatttgctgatttactcaaaaattatgcgggcagaccgaccgcacttactctttgtcgtaacttaaccaaatgcacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaaccgccctagcttgtgctatgttagatatgccgtgtcgtgtttatatgggtgcaaaagatgttgagcgtcaatcaccaaacgtgttccgtatgcgtttaatgggggctgaagtaattcctgtagaaaaaggctcttgttctttaaaagatgcctgttgtgaagcgatgcgtgattggtcagcaaactatgaaaccacccattatttacttggaacggcggcaggccctcaccccttcccgacgattgtgagagaatttcaaaaaatgattggcgaagaaaccaaacgtcaaattctagaacgagaaggtcgtttacctgatgctgtgattgctgcggttggcggtggttctaacgcaattggtatgtttactgattttattgatgaaccaaatgtgcgtttaattggtgttgaacctgcagggaaaggcattgaaagcggtgaacatggcgcaccattaggtcatgcanaagtgggcatttatttcgggatgaaatcccctttaatgcaaaccgaaaatggtcaagtagaggaatcttactctgtttcacctgggctatactccccttttttctggcccgcacatgcttatttatttcagattgggccggcctgttatgcatccattacccgtgttttacccctttattccctcccagcacgcgtattattccacgcttttttccctccccttaaagttccccatcccttccctcacctttttctattcccattcccccccctgttacacattccctttctttcccacccctttttttcccttccccttttcctccttccca

SEQ ID NO: 211 - DNA, 1765 bp, H. influenzae
  misc_feature (389)..(389): n = a, c, g, or t
  misc_feature (457)..(457): n = a, c, g, or t
  misc_feature (468)..(468): n = a, c, g, or t
  misc_feature (1559)..(1559): n = a, c, g, or t
  misc_feature (1574)..(1574): n = a, c, g, or t
  misc_feature (1612)..(1612): n = a, c, g, or t
ctgtatacgatatcgactcggtacccttttcgttggttatcttggtgttggcgcataatcggaagatgctctgcccttcaaaactttctggcactttttgattggctaaatcaaagactgttgaagttaagtcgtgaagataaacaaggttatcatcttcttgatttacacgatcagagtttggatctttgataatcatcggaatgttgtatggctgtttagaaccctatccgccttgtcgttgcagaaaacgctggtttcacttcacattccccttgtagtgccatcagccaatcttgcaccttgtgaaaaggggaaaattggtgacgacgagccactgcagcaaaatcccctggtgtcagcagattaagcgattcaatctgacttanatcctcttccgataacaacggcaatcctaaaatttctgctttggtgtttagcaaaatctcatgcgtgnttgagcgttanataatcaaacttcaattttaaatcaaaacggcgtaaagctgcgtgatcaagaacctcaattaaatttgttgataccaccatcaggccctcaaagcgttcaatttgtgttagcatttcattcacttgcgaacgctcccagcttcgatttgcgccttctctagaaaataagaacgtatctacttcatctagcaccaatattgcattatcggctttcgcttgttcaaaggcttgagcaatattttgttctgtcccgcccacataaggattaagtaaatctgagccttgtcttagcaatagcggcatgtccaactgttccgcaagccacgctgcccaagcagtttttcctgttcccggcgggccatagcaacaaattcgcccttttttcgaccgttttaacccttcactaatacgatgaatattgtcgttacaagccacataatccagttgtagtcggctttgcctaaaacaagcggttcaattttcggtttattttgcgattttaacgtttgattaaacatcatgagcaaagtctcagcaaaatttgatgtattgagttcctttgccacccgaattgtgcggcttaaaatcgccggcgttaatgaccgcactttagcaaaatgctgcacataggccggacttaattttccctcagtcagttgcgtaatcagtgctgacttatttttcaacggcaaatctggcatttctaaaataaaatcaaagcggcgtaaaaaagcaggatctatgcccgaaacagagttagataaccaaatcatcggcacgttattgttttccaataactgatttgtccacgctttatttttttgtgcaacagaacgctccataaacgagccgttaaacacatcttcaatttcatcaaaaattaaaagcgcctgcttgccgttcaatagcgtttgagcaagacgactgtagttcaggcgttgctctgcctccacaacatctccgtcagaatccatgtaagtaatgttatacgccgaaatccccaacgcctgtgcaagcaacccggcgaattctgttttaccagtgccaggcacgccataaattaaaagattcacgccttttcgatgatgttntagggcttggtgcanaataagtaacatcatctctttcatgccgggcatatggncaaaatcatccacgtgcagacctggcactggagccatttccgacaagattttaataggacgcttccctttaaggggtgcgtcccaaatcctcaaatccaaggttcgcccccctctcactagcttgccatttttggggcatactgccgactatc

SEQ ID NO: 212 - DNA, 1676 bp, H. influenzae
atttattaaattacgaataatttttcgtaagactataacctcaacaaaagaaacctataactaagggaaaaaagcaatgaaaaaaactactatcaatatttctaatggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaataatgatgaaaagcggcttatttttaagccgcttttttatatcctcgtttttacataataaagagataaaatatcctacatagaaagtttgttcattgagcgtttggtagattgataaaaaatatatattataagcggtatgattttattgcttgataatagttttttatttttacgttatcgttactttttccaaataacgtgaaattcgcgatcttcttctcggtgagaaattaagaatttagcaaagacatcatccatttcatcttgtttattgactaagcccacccacacttcagcgtattcttcaggatcaatcagtacaccaatttcttcttcccaatcatgcggcgggttcaacaaattccacaccaccgcgttcttcaaattgtaggttgaataaaagaatataggcaggatctaaattttctccagccatttctaagaaaatatcggaagcaatatcaatggctgtatcgggatcaagctttttaatttctgttgccatagagttttgtcgtaaaggttatggttaatgaaagtgcgggtaaatttttttctcttttgatgcggcctatgccatattgttcggaagcgcagtgggtagaatgttatggaattaatcatccatcaccgtgcccctaccttcatgtgctgactcattttaagccgtttcttaatcggtattgagggcggtaagaaacccatgtttccaagattggacgcaaggtcccttctgctcctctcttctgtgtcttgacgttttccgtttattccatcccgtctttcgtgtccccgtctgttcatcttgcggtctttcctttcggttcctccctcctctcccccttgccccttcacctttagttgtctccgtttcaaccagagcttacttcctattttttcccattttattttgggtctattgtgaggaacccctctagccgtgtgccggttcggaattcactatctatctgtgctcgtcattctattcatgtaccattcacggtacctacggcccccccgttgtttactattattatggccttgtcatccatcttcgttttgttccgccatggtcccacgataccagcccgttgagctccaaacgacacgcatatcattttctctcct

SEQ ID NO: 213 - DNA, 1281 bp, H. influenzae
ttgataacgcgtacgggggtaaagtgaagctagagagggcggtatgttataggaaatgtaacaaagggggcaaaggaagtgtaaccgtgggaaaaagtgtgggcatcggttagtcgggaatgtggatagcggcagtataagaaggggaagaatataacgcggggaagatgatgtccgtgacgccaaaagtaaggcgaatgatgtggaaaatgcgggcgagaatatcaaagtaagggtagggattatggcgtgtttcgggaaaagtctatatttgcacagcatttagatcgtatattagagcgagaaattgaatttttaggttttagtcaatattcaacaaaattgcttgcagatgagctaggtaaatataactttgctgaaagtggcaccttgattttatgtcaatataatttcttagcgacagattatttgtttattgcattgcttgatagccgtcatagtatgttagtcgatgagcatttagatattcgccgtacagaatatttggatattactcagtttgatattgcggcacggataaatttgacggatttgcaagtaaacgcgaactctaatcgttatttaacctttataaaaggccgtgttggtcgcaaaattagtgatttttttatggattttttaggtgccgaagaaggattaaatccacaagttcaaaatcaatgtttattgcaagctgtgagtgattactgcgatcaaggcgaactcaacaaagagcaaactcaagcggtaaaaaaacaagtgtttgaatattgtaaaggtcagctttcaaatggtaacaatattgaattaagggaactttctgattcattacccactctaaacgaacagccttttgtcgtctttacggaagaacagaattatggtttggaagagagtattccaccaatacgttcaacattgaaatcgctaacaaaattctctgggtcaggaaagggcgttaccctaagttttgatgcggaattattgaatacacgtattcaatgggatcctatgacagataccctaaccatcaaaggcttaccaccaaatttaaaagatcaattacaaaaggctttacaatcagagaattaatttggaaatacacccaattttggatattatttgacagaacttttgcacaaattaaggtaaagaaaatgcaagttaaaacacttttaggcgcaacctttttagcattaagcctcgcttcttgttccaccgttgaaaagttgtatatcgaattgatgtaccgcaaggcactatttaaggcgactccgttgg

SEQ ID NO: 214 - DNA, 1288 bp, H. influenzae
ttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcctaagatttgaggaattaaatacaatctattaagcggttaaattttacataaaattctactaagaatttaaccgcactttcctttacaagccaaatattttctctacaataccccacctaacgatttaccttgagtaaatccctgacctgaaatcagacaaaagagaatattatgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaattctatgtagtgggtaacattgcaccccataattcaactcaaactttattaagattacacctgtcatcattgaaacagagctttattattctgaccagcttatatgc

SEQ ID NO: 215 - DNA, 1738 bp, H. influenzae
  misc_feature (1576)..(1576): n = a, c, g, or t
  misc_feature (1699)..(1699): n = a, c, g, or t
  misc_feature (1701)..(1702): n = a, c, g, or t
  misc_feature (1715)..(1715): n = a, c, g, or t
aggaccccccgtcaaagttcgatggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagcaaaagccaggggtcaataaccggttngcaattacaactgaaaatgaaaaatccccttttaaagggggccgagaatataacgggatattcgcacagcgaaaatccgggcagaattggggggttccaaatcccaatacggcggctttaatngnngcattatggcaanacgttaaaatggcccctttccac

SEQ ID NO: 216 - DNA, 1928 bp, H. influenzae
  misc_feature (1395)..(1395): n = a, c, g, or t
  misc_feature (1399)..(1399): n = a, c, g, or t
  misc_feature (1412)..(1412): n = a, c, g, or t
  misc_feature (1422)..(1422): n = a, c, g, or t
  misc_feature (1429)..(1429): n = a, c, g, or t
  misc_feature (1455)..(1455): n = a, c, g, or t
  misc_feature (1457)..(1457): n = a, c, g, or t
  misc_feature (1486)..(1486): n = a, c, g, or t
  misc_feature (1545)..(1545): n = a, c, g, or t
  misc_feature (1565)..(1565): n = a, c, g, or t
  misc_feature (1582)..(1582): n = a, c, g, or t
  misc_feature (1588)..(1588): n = a, c, g, or t
  misc_feature (1591)..(1591): n = a, c, g, or t
  misc_feature (1602)..(1602): n = a, c, g, or t
  misc_feature (1627)..(1627): n = a, c, g, or t
  misc_feature (1632)..(1633): n = a, c, g, or t
  misc_feature (1635)..(1635): n = a, c, g, or t
  misc_feature (1640)..(1641): n = a, c, g, or t
  misc_feature (1661)..(1661): n = a, c, g, or t
  misc_feature (1687)..(1687): n = a, c, g, or t
  misc_feature (1708)..(1709): n = a, c, g, or t
  misc_feature (1711)..(1712): n = a, c, g, or t
  misc_feature (1730)..(1730): n = a, c, g, or t
  misc_feature (1749)..(1749): n = a, c, g, or t
  misc_feature (1757)..(1757): n = a, c, g, or t
  misc_feature (1773)..(1773): n = a, c, g, or t
  misc_feature (1802)..(1802): n = a, c, g, or t
  misc_feature (1806)..(1806): n = a, c, g, or t
  misc_feature (1851)..(1851): n = a, c, g, or t
atccccggttactttatttatggaaaaatatcgaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatgggcgcgttgtacagaaaatgaaagtgaaggtcgcttcattttctacggtgcaatgattactgaaggggggaattgcattagtatggtgatggggtgggccttgcattctatgaaaatccacaagcgttacaagatgcaatttcagcaggttctccatctaaagttgtgtatgatagttcgttacatttcttatgttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagnatgngcaacttatttgntctacaacanaattggnttcggcttaaattatcagctttctgngnatccttggttaccaccacccatcggttgnatccgattgctctctcccatgcctaaaccattagcgacccgagatgaagataccttaancagcaaccagcgtataaacnggacgaaataagccgtntggagnggnaatcaaccgcntttctatttccagtaaccttacccnctagnngnccacnncctcgttttttaacctgtangttttcttcttgtcctttgcgctttnggtcgtttctcgtctttttgnntnnggggtcggggcgccgggncgggtggggcgttccggcnctatcttngttcggaagtggagangtctggactccacaccgccgcttcgacgnggcncatcgctgcgcgctctcggcgtgcgcgcccggctcacctccctcntccgcgtgagatgcccgagtcgtgcctgcgttcggggtccgcccgtggcgttcccccgccgtccactgctgcccgtg

SEQ ID NO: 217 - DNA, 2358 bp, H. influenzae
  misc_feature (427)..(427): n = a, c, g, or t
  misc_feature (572)..(572): n = a, c, g, or t
  misc_feature (593)..(593): n = a, c, g, or t
  misc_feature (604)..(604): n = a, c, g, or t
  misc_feature (2197)..(2197): n = a, c, g, or t
ctctgcaagtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagtncagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggntatcaatctattcatactggntgttttagggnaaaggtggcaagcccaattgaagtacaaattcgaacccaacaaatgcatgatgatgcagagttaggtatggcggccactggaaattaaagaaggcaatacaggcagtatgtctgcctatgaagaaaaaatgcgtggttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaatttatgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattattattgatgatttctttctgttttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggngcggaattttattcttctaaccctccaaagtgcggtaatttttaccgcatttttgattatccaatccgtcaaattatttataaaatagggaaatatgaccgacttttaaaatgggctggtgccggttctgacgcgcatcacagcgttttaagtacagggct

SEQ ID NO: 218 - DNA, 1406 bp, H. influenzae
  misc_feature (1372)..(1372): n = a, c, g, or t
aaggggaaaggggggagaagaagactaaagggggcggggacgaacgggggtgggggggtccaataaatgagtggaaaatgggcgtccctaacgaagaatagaaatggagaggtgaacaccagccggtgaagaaaatcaccgggggggggaccgggccaaagccacaggggagaggatgcgagccaaaaagggtacacgcggccggtcacaattggtacaggcccgtgatgggatgggttcggcatatggtggctgaaaaaggtcactctgagcttccgcaaatggtggaacgttcaataaaaggcggcatccaattaggaccgtttgggggtcgcacaatacaacttgatcaaattaatgaagcctgtgagttaatgcacgaaggtaaatcgatccgcacagttattcattactaaggtacgttatgaaactgattgaacaacatcaaatttttggcggttcacagcaagtttgggcgcataatgcccaaatgttgcaatgcgaaatgaaatttgccgtctatttgccaaataatccagaaaatcgaccgcttggcgtgatttattggctttctggcttaacttgtacagaacaaaatttcattaccaaatcaggctttcaacgttatgccgcagaacatcaagtgattgtggttgcccccgatactagccctcgcggagagcaagtgccgaatgatgcggcttacgatttagggcagggagcgggcttttatcttaatgcgaccgagcagccttgggcgacgaattatcaaatgtatgattatatcttgaatgaattgcctgatttgattgaagcaaatttccctactaacggcaaacgttccattatgggacattcaatgggcggacacggtgcattggtattggcactgcgaaatcgggaacgttatcaaagtgtttctgccttttcgcctattttatcgccaagccaggtgccttggggagaaaaagccttttctacctatttaggggaagatcgtgaaaaatggcagcaatatgatgccagctcgctcattcaacaaggctataaagtgcaaggtatgcgcattgagcagggcttggaagatgagtttttgcctacacaattgcgtaccgaagattttatcgaaacctgtcgagtggcaagtcagcctgtcgatgtgcgcttccataaaggctatgatcacagctattacttcatcgccagttttattggcgagcatattgcctatcatgcggaatttttgaagtaagctaaagagcggtcagttttcaaagcagtttgggatagccggctcgagggcggtaaaaagtgccggcaatagtttattcagtctgaactagaagaggcccagctgcaagcggggatcctntaagagtcgaccgcgaggcatgcaagtcataggc

SEQ ID NO: 219 - DNA, 1539 bp, H. influenzae
  misc_feature (1390)..(1390): n = a, c, g, or t
  misc_feature (1474)..(1474): n = a, c, g, or t
atgtatctattggtgcgaacgcagtgattgaagaaggtgttgtactaggtgataacgtgatcattggtgcaaattgctttgttggtaaaaatactaagataggttcaggcactcagctctgggctaatgtcactgtttaccataacgttgagattggagctaattgcttaattcaatcaggaacagttatcggtagtgatggttttggttatgcaaatgatcgtggtcgttggattaaaattccacaagtagggcaagtaataattggtaataacgttgagattggtgcgaatacctgtattgatagaggcgcattagatgccacgattattgaagataacgttattatcgataacctttgtcaaattgcacataatgttcatattggcactggtacagcggttgcgggtggcgttattatggcaggtagcttaactgttggtcgctattgcttaattggtggtgcaagtgtgattaatggtcatatggaaatttgcgataaagtaaccattactggaatgggaatggttatgcgcccaattacagagcctggcgtatattcctctggtattccattgcaaacgaataaagaatggcgtaaaacagcagcactaacgttaggtattgatggaataaataaacgtttaaaagcgttagaaaagaaaatttcttaatttcttctgaggttttattacaaaatccacactttaaaagtttactattaaagtgtggattttttattttactaaacgtaactaaaaaagtttaagcccgttaattaagcagcttatcctataaaacaaataagcccaacttaagttgggcttattaacatatcgttatctttaaagaattacgcgttaccgccagtgatttttgcaacttcagcagcaaaatcttcttcttttttctcaataccttcgcctacttctaaacgaatgaagttagaaacagaagtatttactgattttaagaaatcccctacagatacagaaggatccattacaaatgcttgacctgttaatgaaacttcaccagtgaatttcttcatacgaccttcaaccattttctctgcgatttcttttggtttaccagagttgatcgcaatatcgatttggatttggcgttcgtgttcaaccacttcagcagatacatcttctgggttcacgaattcaggtttagatgcagctacgtgcattgctacttttttcagttcatcagcagaaccttcgcccgcaactaatacgccaatttttgcaccgtgtaagtatttgtgcaattacttgaccatctaggtaagcaacacgacgaataattcatgttctcaccgattttagcaactaatgcagcacgtttttttcttcaaattgcgctttgtaatgcttcgatnagtggaaccctttggtttgctgctgcgaaatcagctactttcgtttgctaaacctaagaaacctgcatcttttgcttacgaagncagtttccccaggttcatttcaactaatacaccgaaaccattttctacacgagcaaggatacacc

SEQ ID NO: 220 - DNA, 1328 bp, H. influenzae
  misc_feature (12)..(12): n = a, c, g, or t
  misc_feature (31)..(31): n = a, c, g, or t
  misc_feature (36)..(36): n = a, c, g, or t
  misc_feature (1312)..(1312): n = a, c, g, or t
cgggtctcggtnacccatgggtaacattatnccggnatccaacaaccattctttcgcctcaacagccgcatcattaccaatagataaataatgccccgacgtttccacaaaaccaccagttttagcgatatctttaccttgagcattaatattgccgtcaattaacgcaatatcgccccatacaatagcgcgcccgcctttttctttgcctgatacattaattgttgagcctttttctaaagaggttttctttgctaattgaatgccgtttttaccttcgccgcgctcgtcgccgccaaggtaggtctctcccccttctttacctgaaaggtcgataactgcgcctgtttttaatgtgactttatcacctgtaatcatcaacttaccgcctttggcttgttgattttgagcggaaatcacgccgccaatttccgcttcgccctctttagcggaaagaacaatgttgccgcttttatctttgcttacagaatcggcagaaagtttaccttggtttcgaatgtttgcagcgcggacattgatattaccacctttagcaaagatatcacctagattgattgcttcattttcaggtgcggcaatgctgtaagtaatggttgggtttattatatcgctgatggtgattttttgccctgcaagtaaagaaatgctaccgccatttacgctaattacaccctcattttttactttgccgccaataaggtttacgctaccgtctttaccaacggtaattaaaccgtgattcacgatttcagcgagcgctttatccttggtttgctcaagggtgaaattacgcgctttgatgttttcgttagaaatatctagcgtagaagccgtaaagccattagtgttaataattgcgtctttacctattgtgataccatttgggttgattaaaaagacttgtccgttagaatctaaaatcccttttaattgggagatttggtcagatgtaacacggttgaaaacggcagagttgctgctttcttgtaaaaactgcaccatttcattttggtcgatgttaaattgtttccaattgatgatagcattgacgctattacggatagtggttttattgccgtctacttgcatggttgctgtaccgtgtacgacgctcattccctgtaaaccgctcgctaaaacagattgcggaatggatgccatgcccaaagatagcaatatagcggaaagtggctttaacgccaagtggcgtactttcgtacgaacaggtttttcactgccttttctgtggaaggtcacaaggggtctcatagagagactcgcaggcagctgnctgtcgttgttttgac

SEQ ID NO: 221 - DNA, 1762 bp, H. influenzae
ggtataccatatcggactcggtaccctgtagaacgtcgctatgaacgttatacttatgcgttatctttattagataaagagcctgatttaaatggtcaagatcaaattgaaattgatcgtgaaaaagcggctgcgccacaaactgaagctgatgcgaataaactttgggatgctcgtgtaaaaaatgacattattaatcttaaattaaaagataaaaaatggtcagaaatcaaagcaaagcttacaaaacgctataatttagccattcgtcgtttaacgcaaacaaaagcagacgatattgttcaaatttatttgaatgcttttgcgcgtgaaattgatcctcacaccagttatctttccccaagaacagcaaaaagttttaatgaaagtataaatctttctttggaaggcattgggactactttacaatcagaagatgatgaaattagcatcaaatctcttgtacctggtgcgccagcggaacgtagtaaaaagctgcatcctggggataaaatcattggtgttgggcaagcaacaggcgatattgaagacgttgttggttggcgtttagaagatttggtagaaaaaattaaagggaaaaaaggcactaaagttcgcttagaaattgagcctgctaaagggggaaaatcacgtattattactttggttcgtgataaagtccgtattgaagatcaagctgctaaactaacctttgaaaaagtgtcaggaaaaaacattgcggtaataaaaattccaagtttttatattggattaaccgaagatgtcaaaaaactactgcttaaattagacaatcaacaagctgaggctcttattgttgatttacgtgaaatggcggtggtgcattaacggaagcggtggcgttaagtggtttatttattgccgatggccctgttgtgcaggttcgcgatgcttatcagcgtattcgtgttcatgaagatgatgatgctacgcaacaatataaggggttattatttgtgatgattaatcgttacagtgcttccgcatcagaaatttttgctgcagcaatgcaagattatcgtcgaggtattatcatcgggcaaaatacttttggtaaaggtacggtgcaacagagtcgttcgttaaattttatctatgatttagatcagagtccgttgggtgttttgcaatatactattcaaaaattttatcgcgttaatggtggttcaacccaattaaaaggtgttgcagccgatattaatttccctgaaattatagatgcgaaagaatatggggaagataaagaagataatgcgcttgcttgggataaaatcccatcagcgagttatacggaagtaggaaatatcgattatattgataatgcagtaaatattctaaatgaaaaacatcttgctcgtattgctaaagatcctgaatttgttgcattgaatgaagaattgaaagtgcgaaatgaacgcccgagatcgaaaatttctatcgttgaattataaaatgcgtaaagcagagaatgataaagatgatgcaagacgtttaaaagatttgaacgaacgttttaaacgtgagggtaagatagcattgaagatattgatgatttgccgaaagatacgaagcaccagatttcttcttaaaagaagctgaaaaatagcagctggattccgttattttaattccagatcagaaaattaatcaagcaacgggctatccgaagcaaaacgggaagtaaaaataataccaaatggggtttgaccgcactttgtttgaa

SEQ ID NO: 222 - DNA, 2591 bp, H. influenzae
tacgctcaatcgcatcaattcgctcatcggttgcattggatcggctgcctcaatcatcgcatctctaaattctaacgggattaatgatcagaaagttagttttacctgcttccatcggcccgcctgaaccgaagatagttggaatatttaaacgcattgccgccattaacattcctggagtgattttgtcacagttggaaatacacaccatcgcatcagcacagtgcgcattgaccatatattccacgctatcagcgattaaatcacggcttggtaaggaataaagcatcccaccgtgtcccatcgcgataccatcatccaccgcaatggtgttaaattcttttgctacgccgcccgctttttcaatttctgcggcaacaagctgtcccatatcttttaaatgcacatgccctggtacgaattgcgtgaaagagttcaccaccgcaataatcggtttaccaaagtcattttctttcattcctgttgcacgccataaggcacgtgcgcctgccatattacgaccttgtgtgctggtcgctgaacgtagtttgggcataaataatctctccgagtaaaatttagggttcgtttgtatgattaattaaccattaaaacatccggcagcttaaccaactgattcactaatagatctaaagtgcggtcagattttacagtgatttttaaccgcacttgggtttcaatgagtgtcatttccattgttgtaacggtaaatccgcagtgacgtgctacgcgtaaaatgtgttgcactgaccacatttgatgctgacccacatcagtacaaattatcgcattatttggtttgcgattagataggctgttgagtaatgcccaaggatcaatcgggcgattgccttgattttcaacataagtgaaatctaattttgctttgaaatttctgatttgttcacgccaaggttcaatagtgacaactggaatggagtccatcatggcatcgcctaatccaataactaaattagtggcaccagagcctgatgctgcaatacagacgcccacttttcccgtggagcgagcatagccaatcgcagccattgcagtcccttgttcattacgacaaagtaagtgatctaagcctgcgtcataaagggcatcgtaggttggcataattgcgccaccgggatagccgaaaagagtcgtgacatgatgtgctttcaagcacgccatgataagttgtgcacctgtcattgtgtttgtttcctgttatttttattttgggataagtttagcattgtagcgaaatttcgagtcattggtagggcttggagagaaaaaaacgaaaaaaagtgcggtgaaaattggcttattttgaatattcctgttcttcccctaaaaaatttagtgaatttttaccgctctttaagcttgcttattgactgattgttagatttcattatattgaaactcttttcatttttttacataggataatttatggtgcactcagctccaaaagcacaaaagcgtgagactttttctggtcgtcgcgcatttattctggcagcaattggttctgccgttggtcttggtaatatttggcgttttccttacaccacttatgaaaacggtggtggcgcatttatcatcccttaccttattgcattattaaccgcagggattcctcttttattcctagattatgccattgggcaccgtcatcgtggtggtgcgccactttcttatcgtcgtgttagcccgcactttgaagtgtttggctggtggcaaatgatggtgaatgtcatcatcggattatattacgctgtagtgttaggctgggcagcaagctacacatatttttctttcactggtgcgtggggcgataaacccattgatttcttcatcggtgaatttttaaaaatgggcgatattaaaaacggtatcagctttgaatttgttggtatggtaaccgcaccattaattgcgatgtggattgttgccttaggcgtgctttctatgggtgttcaaaaaggaattgctaaggtctcttccgtattaatgccagtgctcgtcgtgatgtttatggtgcttgtgatttattccttattcttaccaggtgcggcaaaaggtttagatgcattatttacaccagattggacaaaattatccaacccgagtgtgtggattgccgcctatgggcaaatcttcttctctctttcaatcggctttgggattatggtgacttacgcctcttatcttaaaaaagaatccgatttgacgggtagtggcttggttgtaggttttgctaacagtagctttgaagtgttagcaggtatcggcggatttgcagcattaggttttattgcaacagcgccaggccaagaaattagcgaattaacaaaaggcggattgggttaacattttttgcattccccaccattattaaccaagccccatggggggaaatgcttacgcctgcttatccttttggggacttaccctttgccgacttgacttcattcatttcaatattcgaaagaatgtttatccggcctttcagattaaattccctatagcccgcggaaagcgacactcttcgtgggtgtccacactgcctt

SEQ ID NO: 223 - DNA, 1579 bp, H. influenzae
  misc_feature (229)..(229): n = a, c, g, or t
  misc_feature (327)..(327): n = a, c, g, or t
  misc_feature (345)..(345): n = a, c, g, or t
  misc_feature (436)..(436): n = a, c, g, or t
cataaaatgcctctaaaataaatttgcactattatagtagtgcaaaaggaaagtgcaatatatttatatcgataaaaaggggacattcagtcccctttgtaatgttgtcaaagcattcattattgacggtaatcagacaaaaatcttgctaattttgtaatggcttcctcaagttgatttacataaggaagagtaacaacacggaagtgatctggcgaatgccaattanatccttttaccgtgcacaagtagcactttttcttggcggagtaaatccagcaccatttttttcatcactgcgaatattgaatttttttcacatcaatnttcggggaacatatacantcgccccattggtttcacgcaagtaatggccggtatttgagtgatgagatcataggctttgtttcgttgctcaagtaatcgaccgcccggntaaaataaattcattaatactttgatagccaccaagtgcggtttgaattgcatgttgcattggtacgttggcacataaacgcattgatgccagcatatccaagccttcaatataacctttcgcattatgttttggaccgtttaaaatcatccagccttggcggaagcctgcaactcgataagcttttgataacccattcagcgtaacggttaataaatcaggagctagtgcggcaatgtgatgatgcaccgcgccatcatataaaattttgtcgtagatttcgtctgcgaagataatcaaattattttgacgcgcgatttccactatttcttgtaataattctttgctatacacagcacccgttgggttgttcgggttgatgataacaatcgctttagttttcgcattcacctttgctttaatatcatcaatagcgggaaaccaatttgcttcttcatcacagagataatgcactgctttaccgccagaaagggttaccgcagcagtccaaagcggataatcaggcatcggcacgagtacttcatcgccatcattgagcagtgcttgcatagccattgtgataagctcagatacgccgttaccaatatacacatcattgacggtcgcgccgagaatcccttttgattggtaatattgaacaatggctttacgagcagaatataacccttttgaatcacagtagccttgagctgatggcaaattacgtagcacatccactaaaatttcatctggtgcttcaaaaccgaaaggggctgggttgccgatattaagttttaaaattttattgccttcttcttctaagcgtagtgcttctttatgcacaggcccgcgaatgtcataacatacgtgttctaatttgtcggattttgggaataatcgcatagtgaaatccttttgtttctaataaatttttcgagaaaagtgcggttaatttacgctgaatttttatattgaaaagatttgtaaaaaaatttttgtcattaacaatctgcggtagatacggctaattttttgtgtatttaaaacaaatctatgagttatttagcgcagcataaggggagttaaaacgcaaatcccgcatattacagcatcacgatgacctggccggtttcagtgaactgg

SEQ ID NO: 224 - DNA, 1534 bp, H. influenzae
agccgattagttagatatttcctggtaatcacgcaaattttattgcaaataaccctgatttttcttgttatcttatgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctcttaaaatttaccactgctcgctgattgtaaataatatatctaagtaatgattaaatcagataaagatttttgtaatatataaaataaaaaagcccactatataaagtgagcttctttttagaattaatttttattcctcagttgttgcctcagcaacttctggacgatcaactaactcaatgtatgccattggtgcattatcgcctgcacggaaaccacatttcaaaatgcgagtgtaaccacctgcacgttgagcaaaacgtggacctaattcattaaataattttgcaacagtttcaacgttgcgagtacgagcgaatgctaaacgacggttagcaacgctatctacttttgctaatgtaattaacggttcaactacacggcgtaattctttagctttaggcaaagtagtcttaatgatttcatgactaactaaagcacttgctaagttacggaacatcgcttgacgatgactactattacggtttagttgacgaccactcttacgatggcgcatgatcttatccttctcagaaaaatcttaacctatgaccaaactagtcttcagcaatacttgctggcggccaattttcaaggcgcataccaagtgacaagccacgagaagcaagaacatccttaatttcagtaagagatttcttaccaagattaggggtttttaataattctacttcagtacgttgcactaaatcaccgatataatgaattgtttctgctttcaaacagttagcagaacgaactgtcagctctaaatcatctacaggacgtaataaaatcggatcaaattccggtttttcttccttaatctcaggctgacgaacatcacgtaaatcaacgaatgcatcaagttgctccgccaagattgttgctgcacgacgaattgcttcttctggctcaagtgcaccattagtttctaactcaataacgagcttatccaaatctgtacgctgctcaacacgagctgcctctacattatacgcatttcgttcaaccgggactatacaagcatcaacaggcaaacgaccatttggacgttcttcttgcgtatgtgtacgaaatgaaacagggacatatcctctacacgccgaacacgttaccctactaattgaagcggttttcatcagttaaaggacaacccctggactgggattacaattcaacatccccttctggggtatgtcccgtgcaacaccg

SEQ ID NO: 225 - DNA, 1652 bp, H. influenzae
  misc_feature (1414)..(1416): n = a, c, g, or t
  misc_feature (1603)..(1603): n = a, c, g, or t
cggctcttttacctcgaaacccaattagaaaaactggtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaattagatccttttcaaaaataaacagcccgcagaaattcgggttttttttgctaaaagagctgtttttgtcctgtatagtattagcactgtcccagtgtattatatcaaatcaatcaatatgacaaatcttaaatccttatttcagctcgatttttcgcccaattgtacgcatgaaaaatcgcagtcaaaccctcgccacgcccgcacactaaagatgtcgatttcaacgcaattttagatccttgccgaagtcttttcagatctaccgacattcagatccttattatcaaattctttaacgcaaaattactcaagtaaatgcaaattttgatgatataatcattgtccctaaaaggcaaaaaatcatctgaattggcgtcttgttttttatggtagtaagcttggtagtaagctatttttaactatttaatatatcttttaaaaacaaagtgatatttatctagatcagctttccccagcaacgctaagccattgattctaatatgatcaaattgattaatccaatgtcacaatgttctgctggcaagttgaaaatgcctgcaggggaatcaacaatttttactattttgaaagataaactcaatgacttgttgcttgaaaaaaaattgtatttggtcataaaaaatctgcactttagnnntggtatttaatcccacttttggagtgcagatcaaaagtgcggccaaattttttagaattcttttgaaattaaactttcggctaattgcaaatcagtgggggagtcaatatcaatggaacgataagttggcattaataaaaacgcttggcgcataaaaaaccgttttcttcaagaacttcttgaggcntaaaataaatgggccattgcccaaaaaattgggtattttgaacaagggc

SEQ ID NO: 226 - DNA, 1403 bp, H. influenzae
ggcagattgcagctgcagtcgacttaggtccccggatatacagtaattaatattcgcccagccaagggtaaaataaaaagaaatcgccgtgataacaaataaaattgcgtaatctgaaacgggaatattctcacttaatacattgcctaatcccatattggtaaatatggaaaagagaaacaacaaaaaataaaaccatattgttttagaatgaattatttctttcccaaacatcattaacttccttttgcacaaaagtaaaaaagtgcggtgaaatttaccgcacttttgagcaaaatttatctcaaattatcatttaacctgttattgttgcacttcatcatcttgattgatgaaagagtcatttacctcaatttttgctctctcacgtaatccttgtattaactgaaattgtaattcagattgatgactacgcaataattgcataccaaattgcgacaattctttttcacttaaactgccttgttcaaccttattcaaggcaacaacaaccacatcgccatttgaattatgcaccacttgataaagagcttcatttgattttggtttagcaattgaaaatataccatttgttaaaataggatctttattttcacttaaagtaaaagtctgctcacttgagaaattaatgccatctacttttgattcagggttttcacttaattttttcactgcttgttgtgctttttcattaagcgcattctcagctttctgacgttttaagaaagtttcaatatcgattttagcctcttctaaactttttacgccctctgctttgcgatccaacacacgtacaataattgtgtgataatcgcctacattaattggttcagaattcataccaacattcgtagtatctgattcaaatattgtgtaaataacattagggaaatttaatccagctggcacattttgacgagaaaaataatcactctcttgaaccttaacacctgctgcttgtgctgcagtattaagagacttactgtcttcaaaagccttatcactcgcttgtttttctaaagaaaaataacgactctccattaaagatttacgaactaaatctgcaatttgagctttcacattctccaaactttgcgctttacgttcttgcactaacacaatatggtaattgccatccacattgattggttggctatattgccctacctgcaatgcagctgcggcatcttcaaaggcttttggtaattcattctcatttacccagcctaaatccccgccattctcaccagaaattttatccaaagatttcgctttagcgacatcagcgaaatttgcccctttctggaattcctcgtaagccactttcgcatcttgttcatttgcaaattgaaatgtgctaaatggtgagtcataaatgtgca

SEQ ID NO: 227 - DNA, 1260 bp, H. influenzae
aggacccccactgtctcttgaggtggcaatccgttctacaatcttccagcaagtgggatgaaaatttggaaaactttaaggaacatcaggcgttgttgggggcttatgggaagttgcagaaagcaaagcgagcacatcaaaaataaattaggcttatttcgtactttcaattcttgaaagtacgacctacttttctttgcttcgccaaagaaaagtaggcaaaagaaaagcgcccctgcttttccttatttcctttgtttcatacaatttgcttaaacggaaattttctaaactcgccgcaagcggctcaaacagacgaaaattgcctgaaaattgaaagtcgcaaaggcgatttatatggggccccgaatttatcagagcattatttaaaaagtgcggttaattttaaattcattttaagaacaaaaaatattttgagttttgaccgcactttaaatcggataaagaacaaattgggttcccttcttttccacctttgtggaattgaatttgtaggaaattttcgtctgtttgagcgcagcgagtttagaaaatttccgtgaaacaaattcaatggaacaaagggaataaggaaaagcagggttgcctttctttttgcctactttttctttggcaaagcaaagaaaaagtaagtcgccatcaggcgaaatcctgatatcaaaaaccacatatccacaattttatgctataatccgccacaatttttgatcaaaaaaggaataccaatgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgtttgtatggcacaaccattctcacttcgctatatgtttggttgatggggcagggaactttggttcaattgatggggatgcgccagctgcaatgcgttatacccgaagtgcgtatgcaaaaaatacgcaagcattgctcactgatttggataagaaaccgtcatattctcgccaaactttgatggcgaattattgatcccagatgtattgcccactcgtattccgccctttagcaaaaggtttt

SEQ ID NO: 228 - DNA, 1492 bp, H. influenzae
  misc_feature (68)..(68): n = a, c, g, or t
ccacaccacttggtttattaagtcttgcggcttggggattaggctatttcgggcaaccgcatatttangcacgctttatggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaatgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccactttgtattgagcaaatgcacccattagcgggatttgacactgtattttcaatgggcgtactttatcatcggaaatcccattatatcatttaagcccaatgaaaaccccattggtaaagggggtggatggtcttagaaaactagggggggaggggcaga

SEQ ID NO: 229 - DNA, 2114 bp, H. influenzae
gagagaagaaaagagaagaggaaagaagaatagttagtctgagagagagaaaaggcaaaggcgaaaaaagagaagaaaacaggagcgcaggaaaaacagtaagaagggaaggaaaaaaagaataaagagaagaaaaaaaaaaaaaacaggaagaggagggagggagagagggaagaagagaaaaggggaaggagaaaggagcaaagaaatagaaaacaaaagtaagaggaaaaaagaactaatttatggcggctggagaggaaagagaggaaggcagatagaagaagggcatttaaaaacataaacaaaaaaagaataaaatagaattaaaggaaaaaagcgaggtgaatgaagtggcagatgagaccaacgagatgcggagtgcaaaaggagcaatagaaaaagaagataagggatgataatgatttgattatgcaaaatggggcaggggtaacagccggccgggaggggagtgttgttccgcaggcgaaaagaaaatatgaaaaattacataaagactgtaaaatagatatcttcataattatcaaatatcaatgcttctcacaaaatatccttaaatccataagccccaatatcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcgtctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatgtgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttgccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggtttttgggtaggtacaagctggcatcccgcttattcagcaagctttttaaaaaacggattcgtggcctcggaaaaacataaaagcctggattccaaaactgttttcccatcaaaaaggtttaaccaa

SEQ ID NO: 230 - DNA, 2227 bp, H. influenzae
ctgtatacgatatcgactcggtacccggtttggttaaataatcgtcggcaccaatttccagacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcgggattttttacctgattttccttttttgtgatctaaatcatagttttaggtattcaaatttctttgtgatagaatttcgagcatctatatttttatactcaattctatgaaaaaactctttcttttttttacgctgattttcaaccgcttttgcggcttaattcagggtttattcgattaaaaaaccaaaacctttttaaaagtagatgatgcttttgctttttctgctactttatctacagataaaagccagttacaagcccattgggatattgccgatggctattatttgtatcaagataaaattagtgctgagttagtcggtaaatcaaattctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacacagtgcggtagaaaatatgccttgttctcaagttaaatttaagcaaattaaaaatactgaagaacttgaccgcactttaaccggaaatccgcatccaattgctatgttcaatttatacgcggattggggggttgcttgtaaagaatttgaaagctgacgtttccagatccccagtgccacagcaattcaaaaaatcttatgttacaagggaaattgacaaagcatagcccaaaaaattaagcatcatgggacgctttaaagggaagggaaatgcccaccattttattttttgaccaccaaaatagtaaattccagcgagttgaggaccggctttttgt

SEQ ID NO: 231 - DNA, 1147 bp, H. influenzae
gagacccctttccatcgctgcttgaatagcgatatcaaattgctgacgaggaattaactcacgcattttttcaaccaattcacggccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgaggttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaacaacctcgccattcgttaattgcacttcgtaaattaccgttggggcagttgtgataagatctaaatcatactcacgctctagacgctcttgaatgatttccatatgcagaagtccaaggaaaccacaacggaaaccaaaaccaagtgcggtcgaagtttctggttcatagaaaagtgatgcatcgtttaaacttaatttaccaagcgcatcacgaaacgcttcataatcatcagaacttacaggaaaaagcccagcataaacctgtggttttacttttttaaagcctggtaatacttcagttgcagaattatgttgatgggttaaggtatcgcccactggcgcacctagaatatctttaatcgcacaaacaacccaacccacttcgccacattctaaaacagtcgtatcttcttgttttggcgtaaaaatccctaaacgatctacgttgtaagtttgccctgtggacatcactttaattttatcgcctttacgtaataccccatttttaatacgcactaaagataccacgcccaaatagttatcgaaccaagaatcaataatcaatgcttgtaatggcgcattaggatcgccttctggtgcgggaatttttgccacgatttcttctaatactcttcgatacccacacccgtttagggagaaccgagtcgatatccgaaaacag

SEQ ID NO: 232 - DNA, 1301 bp, H. influenzae
caacttgtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttg

SEQ ID NO: 233 - DNA, 700 bp, H. influenzae
agagacccctgttatttttagtaatttggggtgtagtgattttcaaaaaagaaatcgaagcattaattaatcgctttataccaaaactgcaatttgtgatgaaactcatcggtattgcagaacgtattgcaagtccagtcgaagttattcttttcatattggctgcagtgcttggtgcatacacagggttcttactttctgcattgattagctatccaatgttgaataacccagtattacccgcattatttttagcctctggcacatcatctggtattgctgcaaccttcttaattatcttaattgcaggaaaactaaaaggtgattctcacgaatcgcacttcatccacaaatttgaagtgccaattatggtgacagaacttggtttgattgtgtgtttcttcgttggattacattttggtggcggacaaaaaacagttgccttacataatgccttatctggtttttggggagcgatattctgggttggagtattgattatcggtatcttgatcccattaatcgccaatatgtttgtaaatgaccgtttaaaatacaatcgtaactttattatcttggtgtcaatttttgacttaattggggtattctgtttacgtttctttgttttatatgcgggacaactcactgtagcctaaactgactttttataaaaaattatgctgcatataaaaggggtctc

SEQ ID NO: 234 - DNA, 2050 bp, H. influenzae
ccatacaaggcgtccaaccagaactaaaggttaaaccaagcacaaatgcctcaagtgcggtcgattttcctgatgtttttatttccaccaatttcgtgcgttccaacaaaccaattttaaaaatgccaagttgatgaatacccaaaataatcacgataacgccagcgataatgcgggtagtgttactaaataaaatattccctaaaaagccaaaactaaagcctaaactgacaaatgtaagggaaagccctaaaataaataaaaaagtattcaggacttttttaccacctttactcaaaataccaaaataaattggaataatcgggaaaatacaaggcgaaagaaaagaagcaagcccagctaaaaatacagttccaataaggagttgctgatctaacatcctacatctccttattttttaatggattgaatcaaatatccgtatcctgccttttccatttcagctaacggaataaatttaattgatgcactgttaatgcaataacgcaaaccgcctttatctttcgggccgtcgtcaaaaacgtgtcctaaatgggcattgcccgcacgacttaacacttcggtacgttgcatattgaagctattgtcggtttcataatgcaccacatctttaatgatcggtttcgtaaaattggccagccacaacctgattcaaatttatcatttgaagagaaaacaggctctcctgtggtgacatcaacataaatacccggttggaaattatcccaatattcgttactaaaagagcgttcagtatgtttattttgagtaacggaatattgcaacggtgtcaatttcgctttaagttctgcatcactcggtttcggataatctttttcatcaatcacaggttcatctgctttggtaatatcaatatggcaataaccatttggatttttcttcaaataatcttgatgatattcttccgctacgatgtaatttttaatcggttgtacctcaacttgcactggttttttatatttggtttgaagctgggcgagagcttgttcgatcaccgctttatctgccccatcttgataataaatccctgtgcgatattgtctaccacggtcgttaccttgtttgtttacactcgttggatcaatcactttaaaataatatttaagcaatttatctaacgaaatttggtttgcatcgtaagtaacttttaccgtttctgcgtgatcgggtagcccaatcatatgataactggttttccccgtattaccattggcatagccagaaatcgcatctttcacaccgtgaatacgctccatatatgcttccataccccagaaacaaccaccagcaagataaatttctcggatgttttgtgtattttccattgccattttttgttctccagatgatgatgttgaattttgtattgctaaagttggtgtagcactgcaaagtgcggtaataaatagaaatgtttttgatagtttcattgcttttccttatgaagtaaaaattaacgttacataaggttagacggcggataattcgatttcttacagatttttgcaaaatttttaaagaaattgattaaaatccattgttataaccaataataaagcgttaagatgcccaatctccccctcttttctaaggtaaaaatctatatgcaatcacattccattccttcactttatcacaaagcgattagttttatggtatcagcgtacttttccattaccttgatgaatgtatttgtcaaaacggcttctcaaacaatccctgcaagtgaaaccttattttcacgctttttaatcggcttgcttttcttacttccttttgtgattaaagatcgcgattttaaagtggatactcgtcaatggaaatttttaatcctgcgtaatgccgcgggtgtatcgaatatgttgattaacttttatgtcgtgaagttcttaccgctttccatcgctgtcttattgatgaatacctctgccctatttatcccgattttattgctttttttccatcaaaaaacaccgcttaatgtgcttttatgtagcttaatcggttt

SEQ ID NO: 235 - DNA, 2031 bp, H. influenzae
atagcgatgtatcaattctgtctgtaatcccaaagcaggctgttggcgtaaagatgatgattcgccaaattaaatagttgcgtcagcattattgtgggctctaagttgtgctttaaaatggtttgaacatttgccttgatttctttggcattgtcacccttcacacgttcgccttttatttgcgatgtgcggtcaataatttcacgaataaaaggtgcattttcgttcattgataccctcctatttttcgccgatcctagcacttctgtttacaataaacaacaaaaaagggctttcgcccttttattatgctctgtcccacattgaacttcttgctctggcttggcgttggttttcaatgcgttgtatttgttttgccacttgttgtgcaatggctcgttcgtccatgccttgtgcggcattgatggtgatatttacgctcattggttggctggtttgcgtcatcattggacgagcaaaaattggtgcacgagtatcaacttgcacaggggcggcagttgcaacgctgatccccaatccgcccgcaataagtgctcgtttgccgtaattaagggcgttgagcgtatttacaccaaggcgtgatgtggcttctttggtcatcacgtattcgccaccgtggacaatgcccatgggttcatatttgccaccgtttccagtgtagccgcctgaccaattttgactcggtaattttttgccatttgaaccaaagccagtgaaatccttaaatgattcccaagcacttcctgccgtttcttttgttgattgccaagcgttgctcgaagtgttttttgttctttcccatgcactagatacactatttttaattccctcccaacttggcatattttcagaaatccacttgataccatccattaatcttgttaatggggtcagaataaactcaatcgctttcgccattccatttccgaatctttcccctgcactgactgcagcatctaaatcttctttggtactttgtactggagacaataaatcagtaaaccatttcaccgctttttcaatccaaccgacgacaacaccaaatgcggtgcctagcggttggaatttttcaaggacgggggcgagacctgattttaaaccctcccaaaaaccgccaaaaaaggctttaataggttgccagaatttataaattaatgcagcaacggacaataaagctatccctagtggactgatagccagtgcaattaattttagcggagaaagtaatcctcttaatattagccgccctgcagatgataaatgtcctgaaaatttaggaataattacgtttaatttggataagcctaaaaatagccgtgcggctgggtaaagtataaaacttaaagcaaggcttaatgcacctaatagacttaaacttcccccgattgcaactgctgtttttgctatagtagaggttaatttaggatgttcatcaatccatgtctcgattttatcaagcaaattgccaaccccgtccattaagctagtcatcgaatcttttaaactggctcctacagaactatttacgttgaataaacgatttttaaataattgccattttgctgataaagtagtcattctggtttgaaattccctagccatactatttttagcttcttcgctatttgccagttcaatttgtctgcgccattcttcggtattggcaacaagccctgctaattgggtattataatttccgcctgcaatatcgctaattacgccagcctgttaatgcttaggcaatttttctattttttcaacaatcatcattaatgtgccttgtgcattttttaccattgctttttgaatcgcttttggatcttaacctaacgcttttagtccgtttttaacgggttttattctagcggctttacttagacgggcgcacgttctttcgaccgctttggcttgcgccctgccttcccccccttcttttctcccgttgcccacccccatcccgattctcctcctatccccgccacttatctccttcccgtgttcctcagccca

SEQ ID NO: 236 - DNA, 2107 bp, H. influenzae
  misc_feature (1285)..(1285): n = a, c, g, or t
atggtatacgaatatcggactcggtacccataagtttacataatatttctttaaagtgacgaaccaaaatttagatggtctgacgttaattcaaattcctggatttagtgatgaagaagtcgtatgttcacgtttaaaacgcgatgatatggaaattgttccaaaggcaagtactgaaattcgtatcaacgatattttgcaattagtgggcgatgataattcgcttgccaaaatgcgtttaattatcggatacgaagttgatgcaccaactgttgcctatagtggcgaaattcgttctgagcgtgtggtggtaacgaatgaaaaagtattaggcaaaaagatccgtgccttaggcattcatcaaaaatatggggttgtgatttcacgtttaaatcgtgcagggattgagttagttccaacgggaaataccacactgcaatttggcgatgtgctacatatggtcggacgcagtgatgtactaaatcaggctatttcagtcattggtaatgcacaacaaaaattgcttcaagtgcaaatgttacctgtgtttatcggcattggtttaggagtactcgttggttcgattccattctatattccaggtttccctgttgcgttaaaattagggcttgctggcgggccattggtggttgcgttaatcttagcgagaattggcacgattggtaaactttactggtttatgccgcctagtgctaacttggcgttacgcgaaattgggattgttcttttcttggctgtggtcggtttaaaatcaggcggaagtttctttgatactttagtgaatggttcgggacttgaatggatgggatacggtatttttatcacctttattccattaatgattaccggtattttggctcgtctatatggcaaactgaattaccttacaatctgtggtttacttgcaggttcaatgacggatcctcccgctttagcatttgctaatgaaattaaagaagataacggtgctgcagcactttcttatgccactgtgtatccgttagtgatgttcttgcgaataatgtcgccacagttattggcagtgttattatgggcagcatagtaaaaataatttcaatttagacataaaaagcgcggttaatttcgcgcttattttttgcgtggattttgcgcaagagggtattcaatgatagaattccgcacttttattgctaagtgagaacaaaatggcgttagttgaatttttgatggaaaccttagatgggttaaagggaacagatattgtacattttgatgtacgtgngaaaatcatcgattacggataatatgattatttgcacgggtacatcgagccgccaagtttctgcaatggcagataatttaattacagaatgtaaaaaagcaggttttgaaacttttggtgaagagggtaaaaatactgcagattggattgtagtggatcttggtcaagctatcgtacatatcatgcaacgtgacgcccgtgaaatgtatcaattagagaaactttgggcgtaaatattagtaaagtgcggtgaaaaataaccgcactttttagataaggatgacttgtgaaaatcacgttaattgctgttggaacaaaaatgccttcttgggttacaacgggttttgaggaatatcaacgccgtttcccaaaagatatgccttttgaactgattgaaatcccagcaggtaagcgtggaaaaaatgctgatattaaacgtattttagagcaagaagggaaggcgatgttagctgcctgtggaaaaggcaaagttgtgacgttagatattcctggtaaaccttggacgacaccggatctagccgatcatttacaagcgtgtaaaattatggctccacgctttgtttgttgtttgtcgcgccttatggttttctccccgaaagtaaatgccccgccggaattatattttcccccttccccaaggacataaccttagctccctgttggtgttgacgacgctgaccccccgcccccccccgcgtccgccccccccacgtctttccttttctttataaccccctttcccttttcccacgcgcctcaccttacacagagtttttagttttttcttttctgaccctgcta

SEQ ID NO: 237 - DNA, 2964 bp, H. influenzae
  misc_feature (2060)..(2060): n = a, c, g, or t
cacgccaacgaataacgaagcggccggaacgaataaagaccggacgcgggcaaagggggagagaggcgagaagaagaaacatgacaaaagcggcggagaagcgcaacaaacggggaaagcagacgaaccgggagggcaacagggcgccggcggggtgacacgaaagggagttcgacgggggtaagagacgcgcgcggggcaaataaaacacgcaaacggagtgcccggagggaaaaaaaaaggtgggacgacagacgaaaggccgatggattggggggaaaaaggaggtacgaaaggaggacggcggacaaaaaaagaaaaggagggccacgcgagggatacgggacgaaggaaagggggcaaagagagagaaagccgggggaagcggttagagaaggggggaaagcaaaagggggggagggggggagaaggcgtaaagggatatgaggagggagggtaggggaggaacaggggacggagaacagagggacatggggcggtagcaagacggagggggagcggggagaggaagctgtgaaagcgaggcgatgaatgcaaaagtagcagctacggagaaagaacgttttgcgaattcaaggggggggccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattttgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttatattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatatttcatttaattgatttagatcaaattgacatttttgcaataatttttgttttaaagatgattaatttcattgtgtaagatcatattttaatatttgtctcaaccaacatcatctcttgatgtttttaactgcttgaataagtatgtagtggcatttaatacttaatttatcattcaacatttgtaatgtaattgttgatcctttccaaggataaaaaggattaagccaaaactagcattgagttcattgcgcaaatcaggtaaactaccatcccgtctttgatagctaattatcttcgatttttgaccgcacttttggttgattttgtctgtaagatgattagctataatcatttatattccaatacagattaggttccctatggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggngaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagctagccaatccagtgtgagaagtaaccatcggtatggtatgcaaacacactgagttacccgatgcctataatcaccaaatgaatcctttaaacatctcagtttcaccaatctgcttaattctagcattaattcttattattccctagaatgttaacacaaaagggcccgatatttataaaggcccgcgatggccatctttgttccagtgtgcattcgttacacggttttaaa

SEQ ID NO: 238 - DNA, 1573 bp, H. influenzae
tgttatcgaatatcgactcggtacccgcaaaagtttatgtttaaattggattcgtttaagcgtgaaaaaaccttcatacaaagtttgttcgcccaatatttctatatcttgttggctaaaatgttgaatttctgacatctgttttctccaaaactgcacgcaaaatcatacgcttaaaagactacaaaaaaaatagaaggtttccactttttgttgagagtttgaagtgagtcacaaaaaaacaaaatgccatgattatttattcaacagtcatagcattcttttttagaagtaagtgaaacagtatttcactccatttttacaaaataagcatcttacaaaaccttactcacaatttttccatcagccacttgagttgtaatgaagtccccttgattgacatctttcacgctaacaatggctttaccttgcggattttccgcaatggaataacctctcgccaagacttttaatgggcttaagccatccagttttccgcataatgttgccagtttattttgacgttccgtcacttggcgatttacgcaaaaatttaaccgcacttttaactgctctaagccttgttgataacgttgtatgcgatatggcaatggattttgttttaaacgaacagaaagtgcggtgaatttttgttgtgtattttcaaactgacgcaatattgcaagttgcaagcgatgtgtaagctgttcattcttcgcttgttgagcacgtagctgattctgtggatgttgattttgcaatcgtaaggcaagctgtttcaaacgctggctttttcgcgtaaataaacgatcaaatgccatatctaaacgttgctgttgatggcgaagttgctgcaataattcatcttgattacgactaactaattcagccgcagcagaaggggtcggcgcacgaagatctgcaacaaaatcggcaatcgtcacatctgtttcgtgtcccaccgcactgataatatgtaaggttgaacgaaaaatcgctcgcgccacttcttcttcattaaaacaccaaagatcttctaatgaaccaccaccacgccccacacttaatacatctacttcttgtcgcgcattatcatgtttactcattcgcacaatttctcgagctgcctctttgccttgaaccgcatcgggacttatgaccacttttagcttctctctcctcgctctccatcttctttctctcctccttttccgccctccccttgttttccccttcccctcccctcccttttcctttcccttccttttctcttgttgctttttggcctcccttcctgcttcccccttccctctctccgcattcactctttccaccgccttcttcagttcgtcacccttctttccttctttttccccttttccccccccgttcccctcttctctttttttccctcccccttcttccccttttccccccccttcttccaccttctcttcctcccctgtcatcatcccccatttacccgtttccacttcccgtattaccctctttcgcccctttctctctcctcctcttcgtgttctcccccgctcctttttcccttctcctttct

SEQ ID NO: 239 - DNA, 2068 bp, H. influenzae
  misc_feature (1966)..(1966): n = a, c, g, or t
  misc_feature (2001)..(2001): n = a, c, g, or t
tagttgttttcatagcctttggcaatgcagcacttccatgagtgttccccgattttcatgtagggttgagtgacgtccttggatcttgaaaattcatggaaattgctcgggcgcggatttattcatttcagcattcggtaaattaactaattctttcccttcaaaaatggcagagcctcccacttcacccttggctgccaataaacccattaaagcaaaggctgtttgtgacttgcctgatccactttcgcctacaatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgccgggaaaattaataaccaaggcgacacttccatttgtgcagcaccatcacttaagagtgcgccccaactactcatcggctcttgtgtacctaatcctaagaagcttaagaatgattcaaatagaatgagcccaggcacttcaagcgaggcataaactgccactaagcctaatacattcggaataatgtgtttcaaaatgatttggcgacgaggtacgccacaaacgatggcggcttcgacgaattctttattttttaggctgagggtttgtccgcgtacaatacgtgcaagaccaagccaggcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatagccccataaattgtgccgatagtcacggaaatgaaagcaccagcaataccgaccaataatgaaatacgtccaccgatagcagtacgtaccaacaagtctcgacctgaggcatcggtaccgaagaagtgatagccttccattgttggtgcggagctcatcatattccaatcggtatcttcataggtaaatgggaagaaccaaggcgctacggtgataaatataataataaacgccaaaataatcagactgacaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataacttatccttaataacgaatttttggatcgatgatggcgtataaaatatccacaatcgcattaaataaaatggttaatgcccccactaaaatggtgaggctcaaaactaaagagtaatcgcggttcaatgcgccgtttacaaataataaccccatgccaggtaaaccaaatacgctttcgatgaccattgagccagtaataatccctacgaaagcaggtcctaaataggttatcacgggtaaaagtgcgggacgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcaaatacgaagcttggcataatgaccccaagcatcgagaaactcatcaaaatataatcccaacggctattttgattgagagcggcgagcgtacctgctgttactcctagcacgactgcaaaggcgaaggccaccattcccaaatttatggaaacaggnaaagctgacgcgattaaatcattgactggatgggnctttatatttaaaagaaggaccaaaatctcctttgggaaggattttctaaaataagaaatattgtta

SEQ ID NO: 240 - DNA, 1333 bp, H. influenzae
gtttctaaaataaattttttaattgcaagatattgttctctactctctttatacagcagaacaaagatgtgtttcaccacaagtatcagttattttttgttgccctcctgcagaaaactcatctcttaaactagtgtttattactccatgtttagtcactagccatagtgcgaatttatcatatttatttctaggatttcctaagatcgtttcagggaagaaagcatatgcttgagcaattaacatatctcgctcatatttttctattaccttccagtgtctaactttgggaggggcaatatcatctaaaacattgtttgaagtccaccataaactttcaccttctattaatagagatttatagtatttagctacaggagttattggattatctaattctcggagagaatcatatgtggtctccattttttcaaatatgctctcccccttttctaataacatatctattttatatctagggtaatgggttacagctatatcacataaacacgactcatatggtttggataggaatttaatatttccacctaatttaccaaatgttaagaaaattttttctatatttggaattcgtgtagactcaagaatagaactgccaattgaagtccatttatctccttgtgtactttttacttcaataccataatattgactagctacaatgtctggaaaatgtttccctgatactaaactaatagtgtcttcgaaaggagtattttgagcacaataacaaatagcctcatatacatctttttctaaatcaataccactacgtttcttatagtatgcaattctattttctgcatcatgattaagaaaattatcgactctattcattaatgccgtgaattcatgtaaaggtggatacttatttttagagaaaatcataaataaatcctatttaaaataaagattccattttttttctatatttttagcaatattataagctaatacacatggtaccgcattgccaataattttataggcattactagctgaaacagaaacgttttctgctgttttaggtaaaataaattggtatctatcaggaaacgtttgtaatctagcacattctcttatagtaagacgacgttcgagcatgcctttagataattcgttaatatatttccctccatgctctatgcttagtctacgatattcaatattaccatgatgttcagatcggattgttgggccaacagaattaagtttaatttcaacctgcccttgacaatggtttcccatatatttggcttttgaatatttcttgtgagaggggtctttgactaaaattgggttactgtagact

SEQ ID NO: 241 - DNA, 2287 bp, H. influenzae
cgtgaatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaaaaaagtgcggttgattttaaccgtactttaaaaaaccaaaaccccgaaacgttaaagcattttcggggttttctattattgtgtgattagcttatgcagtaaatcgcttgcctgttgtatatcttgctgaatgtttttgttgaacacaaacagatagctatctccatttggaatgctggaaaaaaagaactccacaaggcgtttttgatcttccagttgtgcgcctgtaatggcttgctggaagttggcatattgtgatgcgtaagttaccatttttgccattgcctgtttaagttcatcactgacaagcggtagtgtaagttgttttggctcgttacggtgcattgctaagaacgcacgtaatacgatcaaatggaattttgggctaatccacattgcgtaggctaaaacaagttcttcgcaagcgtaagtgccgccttgagtgccgcgaatagttttaaatgcgcagatctgcgcatttagatcttcgtcttgaatttctttaattaattcttgagtggtttctaagcggataaattgatttgggcggtgtttctcttttcgaccgctagcaacgtgtaaatcgtttaaagagaaaagattttcgtatgaacgaatagaattgttgagaatggttaagtttgacatatctgattttccttttgatggaacccctaattttaggttagggcgatcgacagctcaaaactggtcagataatccagcggacgtattcccttgcggtattgtattagtcgcactgtcgatcattgaataaattgttaatttttgctccgcacttctaatgaattaaataatggtggtttaactcactaaaatttggatacaaaaaaatcacactaacggggtgaaaaccgtatctgataaaggtttttgagaccttaaattaatcctaatgaaattctcggccattgtaaagagaaaaaagtaaattatgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaatcaaaaagtgacgttacgcaaggaagaggtgccaccagtagaaagccgcgccaaacgccaaagcaaagcgggacagacgaaagtaaaaaccggcaaacacaaactgggcagccgcctaatactcatgcccaaaaatttcgagtttcgcgaatggactgggataaaagaaagacaccaataattttggcaattttacccatctcaccacttatcaaactcgttgataaagcctctttttttcttctttttgaaccgaccct

SEQ ID NO: 242 - DNA, 2092 bp, H. influenzae
  misc_feature (2063)..(2063): n = a, c, g, or t
acgtgtttaagtttcatccctttttcatatttgcccgaaaccacacgcataaacgccactctgtcacggtgtttcggatccatattggcttgaattttaaacacaaaaccactgaatttttcttccgcactttccaccgttcttgtatccgcttgacgagattgcggtttcggcgcccattgtgttaagccatcaagaaaatgatccaccccaaaattacctaatgctgtcccgaaaaatacaggggtaagctcgcccttaataaaggcatcttgctcaaattcattacttgcgccttgcaccaattccaattcatcacgaagctgttgtgctaaatcatcgccaacagcaacatctaattcaggattattcaagcctttaacaacacgcactgcctgaatggttgaaccctgccctgattgatataaataggtttcatcttttgcaagatgataaacgcccttaaacaacttcccacagccaattggccaagtaattggcgcacaacgaattttcaacacattttccacctcgtccaacaattccatcggatcacgaatatcacggtcgagtttattcataaacgtaataatgggcgtatcacgtaaacgtgtgacttccatcaacttaatcgtacgttcctccacccctttggcagagtcaataaccatcaaacagctatccacagcggttaaagtgcggtaagtatcttcagagaaatcttcgtgtccgggggtatcaagcaaattcactaaacaattattataaggaaattgcatcacagaagtggtaatcgaaatcccacgttgtttttccatttccatccagtcagatttcgcgtgagccgccgagcctttgccttttacagaacctgcagtttgaattgcattgccgtataaaagtactttttcagtaatcgttgttttacccgcatcagggtgggaaataatcgcaaaagtgcgacgtttattaacttcttctaatggataactcattgtttcttctttgttcaattaaaaatgtgggctattttccctgattttaggtttttgctcaaacgaatttgtaaataaagtgcggttggttttcttagaaatattggtctgctttgtacaaagacaaattttcgcttatactacgcaagttttttacgctaacaacataggaaaaattatgggtttcttaacaggtaaacgcattttagtcacaggtcttgcaagcaatcgttccatcgcttacgggatcgcaaaatcaatgaaagaacaaggtgcagaacttgctttcacttatttaaacgataaattacaaccgcgcgtagaagaatttgccaaagaatttggttctgatatcgtgcttcctttagatgtggcaaccgatgaaagcatccaaaactgctttgcagaattaagtaagcgttgggataaatttgatggttttattcacgcaatcgcatttgcaccaggtgatcaattagacggcgattacgtaaatgcggcaactcgtgaaggctatcgtatcgctcatgatattagcgcatacagctttgttgcaatggcacaagcggcacgtccttacttaaatccaaatgccgcattattaacgctttcttatttaggtgcagaacgtgcaattcctaactacaacgtaatgtgcctagcaaaagcctctcttgaagctgcaacgcgcgtgatggctgctgatttagggaaagaaggtattcgtgtgaatgcaatctctgcaggcccaatccgcaccttagccgcatcaggcattaaaaacttcaaaaaaatgctttccacctttgagaaaacggctgcattacgtcgcactgtcactatcgaagatgtgggtaactcagcggcatttttatgctctgatttagcatcgggcattacaggcgaaatcgttcacgttgatgcaggtttcagcatcactgcaatgggcgaattaggcgaagaataatttttcttacattcttttttaggcaggcttttcagtctgcctttcgctttttaaaatataacgatgtttcaaaataactatgtttcaagataattatgttncaaggggtaccgagccgaattcgtaaaca

SEQ ID NO: 243 - DNA, 1549 bp, H. influenzae
  misc_feature (288)..(288): n = a, c, g, or t
  misc_feature (1512)..(1512): n = a, c, g, or t
  misc_feature (1522)..(1522): n = a, c, g, or t
ctttgaaaaaatattagaactttcttcaaaaaaaataacctaaggttacccagccaaaattatagtttaaatgggaaaaaacccaacgatgaataggaagaatagattaatagaagctttaaaattaattgattctgaaagtattccaagtggagttcgccaagcatatgcccaattattaaataataagtagatgttgtttactaacaaactctacagtactgcccccacgatggcgcactcttcccagcgtgtgcctaacttcaataaaaacacctcaaaaactcnccgcactttaatttctagggcacgcgttgggaaacgcgcgtcggcataagcgttaaacacaaaagtgcggtgaaaattttcaacgtttttagacttattgcaacaaccaatccaccacataaatcacttcaatcccatcaatctctgtttgttcgtaatatttccccgtaattaaaatctttttatagttatctttaatatgcaaaagattatctgtttcgtgggtattttcagggatttcaaaagcgacttgtacatataaaatttcatcagcttttcgggcgataaaatcaatttctttgctgtcgagtttacccacatcaacggtataacctcgtctaagcaattcaataaagacaatattttctaggcgattggcataattcgcaccttttttgccgatagcgtgtcgtcttaaaccgttatccacaataaaatatttggcattggtttttaaatagccttttccgcgaatatcgtattgttttgctttataaaaaagaaaggcattttctaacaaatcaagatatttgcttatggtgtgatttgaagtgggaacacgttcggacgtgagcgtgttgctaattttgcttggattcaccaactgccctacgttatccgctaaaaagagaattacacttttaagaatatgcgtgtctttcactccagctcggtgggcaatatcatttagcacgatggaatcaaaaatacccgataaaatcgtttcttttaaaggctcatcagccatcacaacgctggggaaaccgccatatttttcatattccgaatagagtttatcgaccaatcttgattggctatccacatttttggcgtgcaaaaattctttgaaagaaagcggataaattttgatttctacataccgaccgcttaacaacgtcgcaagctcgccggaaagcaagttagcattggaacctgtaatcacaatgtcagcgttaaaactcacgcgaagcccattgacgattttttgccaaccttccacaaactgaatttcatcaatcagaaagtagattttcttttgagaagacggcattttttcttgaatcagctgttgaaaatcttgagcgtctttcacccattgatattcaaaagattcaaaattgagataaagaatattttcggaagcaatgccttgttgttgaaggtaatcacggtattgcatgagtagcaccgatttaccggaacgacgaacacccgagggggatnctatagagtncgacctgcagggcatgccaagtctggc

SEQ ID NO: 244 - DNA, 1184 bp, H. influenzae
ccgatactctgccttagaaatgcttgggcaagtcagttgcatcgggtgttattccgtgtcgtaccaaaagactatccagctgaatttattgatgcactaaaccaaaaacgtggcagatgaactctttgctcgaggagaagcgaatattggcgtgactaaagtaggcgacaaacaatcactgaaaatgactaccctaagcccgattgcaacattggaaaatgttaaagcgttattaactcaagtactaacagaagcaaatcgcattaaagatgacatcaaaaatggcacttacacaccacccattgattaattagttagtcaattaacacaaaaaataaccgcttgtatctgaaaacaggcggctattctgtaaaataaaaatcttttagcatagatcaaacgagatatataaattttatccattagataactacctatatttttgaaatattcatcattttaattttcaaagaatataaaaaaatggtaaaactaaccgcactttatatcattattctatccacttactaagttgaaaatcatgccagaacttcctgaagtcgaaactgcactacgtggtattagcccttatcttaagaattttacgattgagaaagttgtcgtgcgcaagcctaaattgcgctgggctgtatcagaagaattaataacgctaaaaaatgtaaaaattgtcgatctcactcgtcgagcaaaatatttgattattcacacggaaaaaggctatatcatcgggcatttaggtatgtctggatctgttcgaatcgtgccacaggatagtgcaatagataaacatgatcatattgatattgtagtgaataatggcaagttattacgctataacgatcctcgccgtttcggtgcttggttgtggacggagaatctagatgactttcatcttttcttaaagttaggccctgaaccactttctgatgaatttaatgcagaatatttattcaaaaaatctcgtcaaaaatctaccgcacttaaaactttcttgatggataacgctgtggtagtgggcgttggaaatatttatgcgaatgaaagtttgtttatttgtgggattcatccccttaaactcgctaaaaatttgacgcgcaatcaatgtttctctttagtgaaccgattaaaggaggtttgggaaaaacccatattcaagtgggaca

SEQ ID NO: 245 - DNA, 1146 bp, H. influenzae
ctatattaaagaacaagaaaaattagtatggatgttccaagcagcgtgccaaacttgccataattaatgaataaatttcaacgctaacgaaaactaacctgcaattaatctaactcaataaagttagattaatttaatttgtctaagattaaatttgatccagcaaattacctcaaaagtaagagtttcctatttagaataagaatgtcaaattcagtctgaataaaggaaactcttatacctattattcacagtgatctctttaaactaatttagttaatttagccactaaatttaacgttttttaaatcagtaaataaatctatagaaataaatattgtagagcgttaaaaattttgattattaactatttttttagttgataaaatatattcttgagaatttagagttaaattaataggataaaaaataatttaaaatgaagaaatattaaatttgttagctattttattatttcttgtccaattagataaaaaaagcccctaaataattaggggcattaaaaaggaatttatgaataaaatctctaaagtttagcttcatcaaaggaatctcgataaaacgccaccattatattgagtaatctaaagaatagcaagaaaaatctttacatttctttacaaatctttacatttcagcatttcgataattacttggacagtattttccatgccttgtaaagaaaccaactcgtgtttactatggaaattatagccgccagtaaaaatatttgggcatgctaaacctttagaggctaaaaatgccccatctgtaccgcctcgaatcggcttatgatttggtttaattcccaccgctttcattgcgcgatcagcaagttcaattgattgaggaacgttttttaccacatcatacatattttggtagctatcttgaatttctaactctataggctttttcaaaccttttttagcattaaatttttccacctgatttttaataaaagcttttctttgtgcgaaattctgttcgtcaaaatcacgaatcaaataggtaagctctacttgctcaatatcgccagaaaaatcttctaaatgataaaagcccgctttcccatcggtttttttctggtacttcatcaacaggaaaacttgctgaaatcacaga

SEQ ID NO: 246 - DNA, 2155 bp, H. influenzae
  misc_feature (1910)..(1910): n = a, c, g, or t
  misc_feature (1988)..(1989): n = a, c, g, or t
  misc_feature (2091)..(2091): n = a, c, g, or t
  misc_feature (2093)..(2093): n = a, c, g, or t
  misc_feature (2103)..(2103): n = a, c, g, or t
cctcgcggcatggaggggaagggttatccttaaccccggcgatgctaaatcgaggatccccattgccggtagtaggttggtcatcattaatgtcccgccattgtgtgttctgtagtgaattgaccagttagcgttgagtgagcattggcgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcatttttatcaaaaggtgcgccatccacgccgaaagtggtaacagatattcctacaatatcttttaaatcaatgccttgttgtattaattgattgaaggtttgagttgcacaagagattaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagtgcagtcaaaaatccttatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgctccccaatttgccatgactgaatacacatcagtaaatgcaccttttccagttaaacgtggaacaaaccatgttgttggccaagtttcattagtacgttgatttaatttattatgtacatcttgaggtaggtcgattgaccatccttcagcaatttgtagaacgggacctagacctttaataaggttaatgcggtgcattgtaaacggtatgccacctttggttaggaattgagaagataaaccgcccccacgaaaatattcgtgaacagcaggacaccaacgcgtattttctaagcaacgttttgcttcttcttcggtgacatcccatgccggttttaaggttggattgccttgagcatcttgatgctctcctgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcatagcctccataaaatctccgtttggcaaatgatcagtccaatgacgctgcccttgaaaacctgctgcaatggcattatggcctaaggcttcttctgcataatttaatgttgctaattttggatttcctaccatcaaatcacgagtgataatggtcattttcacaacattttcccatagttctgcacgctcttctgcattgcgttgattctctaggctattacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaaagctgatttacatagagcctgncattcccatggaaactgacccatagataataaggatttcctcgaatacttgcacagcagcccagcacgagcaaacgcnnatatttttctttcatctcaggatagggtggggcatcaagctcttgacctctgtaccgaaatggaaagccttggagtcctaattgaaatgaccagcagggcananctaataacgnccctgggcgtttggggccttaatcccaaatgcttagctttgaaggtcataaa

SEQ ID NO: 247 - DNA, 1809 bp, H. influenzae
  misc_feature (1504)..(1504): n = a, c, g, or t
gcttaataatggattaattcgatttgctatccaacctaataacggcacacccaactgttggataacctttaccgttaataaagcgtgatttacacaaccatctttaattccaactacaagtactactggcatttttcgttgagtaatccaatctgcaaaactttttccttctgccattggtgtcattaaaccaaaagatccttccaccacaacagattgataagtttgattcaaatgcgttaaatcataattaattttatctaatttaattcgcattttatcttgcgtgagcatgggtgcacagtggctaaaagtataactattaatatcctgataagacacattttcttttgttgaatgcatcagcgttaatacatcagcatttacgaaatgatcataatcagatgtattttctgattgtgcgataggataaatactctcttctccacaacaagcaataggtttatagccgacaacttgcactccctgctcttgcaaggcttgaatcattgcgcgcgctgctgttgttttccccacattcgtatctgtccctgcgacaaaaaagctactcatttttttctcctttaaaaagtgcggtggattttaaaggaattttttatttaataatttgagataacgcaaattttcactttttttatcttataaatagacaaattatttgatctcactcaagctattaaataaaccatcatcttgttttgctatttgtaagtaaaatccttggcgtttaattgtttccaatacttcattacaatctacattgtatagtgctttacgcccaagcagattaaacatcatcactaattctggtttaccaaaatgttcgagtaaaacgctgggaactaaagaaaaatcctctctattagcaacataaaggtaacttcctaacttctttttacttttataaatggcacatagcatatttaatttcccgaaataaaaatccgcacattttacgtgcggattacaatttatcatttcctatttttgaactgtggctaaaaattctttacgagtatctctatcttctaagaatacgccaccataagcagatgtgacagtataactatttgtatctctaataccacgtgctttcacgcaaaaatgggtcgctttcacatataccgccacatcatcggtttcaagaatggtttgaaatgctgtcaaaagttgctcagttaagcgttcttgaacctggggacgttgcgcaaaaaacgagcacaattcgattaattttagaaagaccaatcacccaatcttttggatagtacgctacacaaactttaccatcaatcgtcacaaaatgatgttcacaagtgcttgctaaagtgatgtcattcacttgcgccatttcggtgactttcatctgatttttgattctcgacattttaggaaaattggcataatccattccactaaaaatctcatcaataaacattttagctaaacgatttggcggtggttctaaactatcatcccgcanaactaatccgatcagcttcattacttcatgcatgtgtttcgcaatgctttcttcgacgttcatctttagcctgtgctggatcaatcataggtgtctcaatacctttttcaatcaaggcatttcttacattcagagcatccagggaagatttgctcataataggctttcctagaaaataagcggctattctagcaaggatattggatggtgaaaagagaaaaatgccatttgaatgaattagctttaaattaaaaagccgcaaattttatcagtagggtttttatgcttacttgggaccagctcga

SEQ ID NO: 248 - DNA, 1804 bp, H. influenzae
  misc_feature (137)..(137): n = a, c, g, or t
  misc_feature (218)..(218): n = a, c, g, or t
  misc_feature (1777)..(1777): n = a, c, g, or t
atagctggaacgttcgctttttgcctctttatatgaatttacaggacggcaattttcacaaggcatgaaagaattgcttgattattcagaaaaatcggcagaaaaccgaaaacttgcacaacaaattttaatgcggngattattctgatattacgccaatttcgattgagcaattatgggctcgttgtccagaagatattttgtgcgtaatacgcccnaaacaaattgcgtggcatacaagtttgctggtggatttcgttgaggcattattagtgaaaattagtaatcgcttttcacttggcggcacagaagtgtttatttattgccaagaccaaccgcacttatttaataaagtggtgagtaccattggcgcaaaaaaattcagtatccacgatgcacagattattacgacacaagatggttatgtttttgatagctttatcatcacagaacttaacggagaattggttgaatttgatcgtcgccgagaattagagcaagccctaacattagcccttcaaagtgaaaaattgcccgcactttctattgtgcctaatcgccagcttcaacattttactgtacaaaccgacgtgcgttttttacaggaaaacaaaaaagaacatactcaaatggaactggttgccttggataaagcagggttattagcccaagtgagccagatttttactgagttaaatctaaatttattaaatgcgaaaattaccaccgtaggcgaaaaagccgaggatttttttattttgacgaaccaatttgggcaagctctggattctcaacaaagagaaatattacgtaacgtgctgtatcgaaatattggatagtcctttttataaaaatatatttctaggtaaatttgccttatgttatcctttacaaaaaattttagggtcacactatgctgagtatttttgttacttttcttggcgcgtttttaacattgattgtgatgcgaccacttgccaattggattggattagtcgataaaccaaactatcgtaaacgtcatcaaggcacaattccactaatcggtggcgtatcgctttttgttggtaatctttgctattatctgatggaatgggatcaacttcgattaccgtatctttatttgttcagtatttttgttttattggcgattgggattttagatgatcgctttgatattagcccttttttaagagcaggcattcaagcaatattggcgattttaatgatcgatcttgggaatatttatcttgatcatcttggtcaaattttagggcctttccaattaacgcttggttcaattggtttgattattaccgtctttgccactattgcgattattaatgcctttaatatgattgatggtattgatggattgcttgggggactctcttgtgtttcttttgcggcgattggtattttaatgtatcgagatgggcaaatggatatggcgcattggagttttgctttaatcgtatcgattttaccttatttgatgctcaatctagggattccatttggaccaaaatataaggtgtttatgggggatgccgggagtacattaattggctttaccattatttggattttgttattaagtacgcaaggaaaagggcatcctatgaatccagtaaccgcactttggattattgcgattcctttgattgatatggttgcgattatttatcgccgtgtacgtaaaggtaaaagcccattccgtccagatcgtttacatgttcatcatttaatggtaagagcgggtttaactggggtctcntagagtcgaccgcaggcagcaagctgg

SEQ ID NO: 249 - DNA, 3057 bp, H. influenzae
atgttggcggaatacagactcggattccgttaaccttgcagcccttctatatatccgcaccaaacttttttaagcgggaaataatcgattgaactaattcttctggtgcagacgcgccagctgtaatccctatggtttttacatcattaaaccaatcatcttgaatatcggaaggatcatcaagaagctgtgatttaatccccattcgagacgccaattcatttaaacgatttgaatttgatgagtttttagaccccacaaccaacactaaatctgataatttagccaattctcgcaccgcttcttgacgattggttgtcgcataacaaatatcgtttttatgtggcccttgaatagcgggatatttttcctttaatgcagcaatagtttctgctgtatcatctagcgataaagtggtttgcgtcataaaggttaaatcatcattgtcttgcattggcaaacgtgcaatatcttctactttttcaatcaagaaaattccgccatcttcattactatactgccccattgtgccttcaacttcagggtgtcctttatgtccaatcaaaatcgcttttgttccctttcgacttgcacgagcaacttgcatatgcactttggtcaccaaaggacaggttgcatcaaatactttgagattgcggtctttcgcttcttgtcgaacggcttgagatacgccgtgcgcagaaaaaatcacgatcgcaccatcaggtacctcgcttaattcttccacgaagatcgcaccacgatcacgcaatccgttcacaacaaatcggttatgcaccacttcatgacgaacataaatcggtgcgccatgaatttctaaggcgagttcaacaatactaatagcacggtctacaccggcacagaatcctcgtggattggctaaaattatcttcatttttgaccgcacttttctacttgtttatcttgtacttttttcttttcgctcttaaacgcatctaatgctaataaccctgcgccaatacaaatggcaatatcggcgatattaaatactggataatggtaaatatcccaatagaaatcaaagaaatccacgacgaaaaccattgtaagtgcgatctaccatattcgctaacgccccaccaatagtcagtgcataagcagaattttggattttttgttcggcattattttttgctaaaaaatagaccaacattcctgaaatagccaatgccaacaaaataaagaaatattgttgccaaccactatgatccgctaagaaactaaatgctgcgccataatttcgaacataagtcaggttaaaaacaggcagcacattaacactttcatacaaatcaaatttttgtaccgcaatgtattttgtaagcaaatcaaccacgaaagcgaccgcacttaaccataaaaatgaaagccctgattttttggacatactatttcccttttaaaaaaattccgctaattctagcacaagccgataaatgataaagcacgatctcatttactgaacggcttctggtaattttgctggatcatcagccaactctttaacatttacaacgttattccaatcaaatactttaatttcctgtttttcaggatggaagaaatccacgccttgtaaatgtttttccttaattcccatccaatcagcaaaaccataaacaaaattaaatgccgattgtggcgtttttattttttctagctttttactatcactcgaaaacataacgaaaggaatttcataattttgtttataaagattatttggatgcaatgataaaccttcagaatcctcataatgagcaagcccatgatcagaaaagtaaatcaccgaatagggttcattttgcgatactaactgcgaatttaatttttctaaaaactgatccgtatatttaatcgattctaaataacaagacatagattgattaataaaataatttttaacttcgtacggaagacgctcacaaaaggctggatgtgagcccattaaatgaatcacaattaattttggattcgtaatattttcttttaaggctttatctaatacaggcaacatttcatcgtcataaacttttttagagttataacctaacggcttcataaaaatcgtttcatctgcactttgaccaatacgagaggccatcgtatcaaattccccaattttgccttgattagaaatccaataagttttcacgcccgcttttttggctaaagaaataatattatccgtataaaccgtttctcctttatctgctcgatatagggtgtgttgtaaagacggttgcgtattcggtgctgcagaataataattttcaaaaactgtgcttttcacacgctctaaaaatggcgtggttttcagtggaaagccatataacgacatataatcttttcgcatactttcaccaataattaaaatataatttttatattttggcgtaaaagattgaatatcccattgagacggcgcattaacggattgatttagaaaatctcgttgttctaaatatagatcattcattcgatcaaattcagaataaaaaagaactggataaaaacggaatttataggcgtagttccaattagaaaattggttataagaaaaaactaataataggctgataacaaccatatttagccatttaaatgcttgttgtttaacataaaaacttaatttcattaaagcaacaaataaaatgatataactaacttgaaataaaaatatccaaaaaggaatggttgtgtaatattctaaggtttcattaatattcgcttcataaacagaagcgataatccccaaagatggaattcgatagaaataaccagcagagcattaatatagcgcactgaggaataatacagtaattaatattccccccaatgccaggggtttaaatattaataatcgtccgtgataacaaataatattgcgttaattttgaaacggtatatatctcacttattaccttttctaatcctaatttgtttattttcgaatgtaaatcaccccacaataccccaccttgtttttgtatgtttttatcctccccatcttct

SEQ ID NO: 250 - DNA, 1086 bp, H. influenzae
  misc_feature (1030)..(1030): n = a, c, g, or t
  misc_feature (1052)..(1052): n = a, c, g, or t
  misc_feature (1067)..(1067): n = a, c, g, or t
atggtatacgaatatcggactcggtaccctttatacttagataaatcaatttggtatacagcaaatccaacttcatctgtacccacttgtttcattggatactgtgctttttctttgatgaattgagctgcttgttcgcttggtgaggtttcaaaacggacatctaatttatcgttacctgagataggcacaaaacgccagtttttatccgcgctagggtttacagaaccttctttttcactggttactttaatgtaatcagctaaaatttgacggttttcatctggtgatgcgtaaacaatatgttgatcgccagtgcctgggaatttattaccgtaagcacgatagttattcgttgcaatcaagaattctgcttttggatcaaccggtttgccttgataagtgagattcactacacgatgcgattctgggttaatcaatttacattcaccatcataacgtgcaggtttagttagatcatattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgttgctttaacaacgactaatgtatttggatagagatataagtctgccgcattacggaaagttaattcacctttatttacttcggtataacctgtagggtcatttttacgaccaccagctttaaatggcgctcctgcacttaaaataggtaagccagccattgctgcaacatttggtgcaactttttctacatacgctttttgtgcttggttcactatttggatggttggatcatcttgcactaatgcaagatagctgtacatattgtctgtggctttaccaataggttgagaaacaaacttacgtgtagcttcgtgaactggttttaaaagtgcggtaatttctgggtcatttctgcaagcactttttattttagcatcatagattggcacgaagtactganctttcaccagaagagtggggtnacccgtagatcccgnataattcggtaatacccta

SEQ ID NO: 251 - DNA, 2213 bp, H. influenzae
tgtatacgatatcgactcggtacccgtgttattttggtggtggcaatgttaattgcaccaggaattaccgcacttacgcttaccaaatcttttgataaaatgttatgggttgctattgcaagttccattgcatcaagcctaattggcgtaatattgagctatcattttgatgcctcaacaggtgcttgtatcattcttctgcaagctgcattttttgttatagcattagcttatagcaaaattagaacaagataattttccttcccccctctttctcaaagaggggttatataatcacaataaatttatccgtttgtggaaaaataaagtcattagtctgagactaaacctaagccaaatccaaccccatttgccaaaacgcaatttccattctagtggcggtggtaaaaatctgttgaatctcggtaagctggcttgagtttagcggtttacaaagtgcggtaagaaaatcaacggtttcttgggcggcttgttgaaattcctcgctcgcataagtgtcaatccacgtttgataagggttgttcggtaagcgaggataatgctgagtaatgtaacgagcaacttgagcataacccaaagcacaaggagtcacagctgcataaagctcagccaaactgcccgtcatgccgcaatcaagcaaatagcgggtataagcaatacaagcgggactttcttgagtagcaaaaatctcttgctcactaattccccactcacggcaataatttaaatgtagttgaatttcttggcagagtatctctaaggttttgcgaggtatttccatttcagcgaaattttttgctttatacacgcccaaggcaaaagctcggctgtaatgaaaaagatagagataatcttgctttaaataatgctgaaaacaagcttttggcagcgtaccttttgcgagctgttgcacaaattcgtgttcaatatattgttgccaataaggctgggcttgttgaatgagttgttcaatcatcttttttccttattcaatttctaccgcatattctttcaacgctaaggcttttggaattaagcctttttgttgcataaattctgccatttgttgataacgtttagcgtctaattgacgaggtttattggctaagaaggggagcgtgtctttccacgccagttgatttaatggcgtgttgagttcgttcggtttatagctgacaaaggcttgccacgcttcattggggtgagcttgcagatagcttgtggcttgttcaagtgcggtcaaaaaggcggatgtttttttatctgttacgctgtttttattggcaactaaaatcaattcatcataagcaggcacgccatattgctcagggaagaatgcgacgccttcttgcttttctaaagcaagctgattgagttcaaaattacgaaatgcaccaatcacagcatccacttgtccagttaaaagagaaggcgaaagcgaccaatttacattcactaattccacatctttattgcttaaaccaatagaatgaagcatggtgtcaagcaatccatcttcaaaaccgctgacagaataccccacttttttaccttttaaatcagcaagggtttccaaattgctcttttttagtaccactacgctatttaatggatttgaaatcagtgaccccactcgtactaaaggtaagccttctgccacttgttgataaagctgaggctgataactcacggctaaatcaacttttcctgccgccgctaatttcggcggtaatgcaggatcagcaggttcgataatttcaacctccaagttatttttttcaaaaaagcctttttgttgagccacaatgatggctgcatgatcggggtttacataccaatctagcattacgctgattttctcttttgcaaagctaggaagcgtgagcattagccccattacaaagctgaaataacggatgattgtcttcattttttctcctttaatgaaaagttaaacagaccaaataaaacggtgtaatagccaatcaatgctgaaatataaacagagtgaaattgacactaaaatcagtaaggcggcaaacattaaatcgacttgcattcgggcattggcgtgaatcatcaaataccccaagccttcagatgaaccgacccattcacctaccaccgcaccaatcggggcgaccgaaacggcaattcgcaagcccgaagcaaaagcaggcaaagccgcaggt

SEQ ID NO: 252 - DNA, 1976 bp, H. influenzae
  misc_feature (1286)..(1286): n = a, c, g, or t
  misc_feature (1929)..(1929): n = a, c, g, or t
  misc_feature (1946)..(1946): n = a, c, g, or t
cgttttcgaatatcgactcggtaccccctccttatttgcatttattagatatcctatcaatcaaggaacggttggcattccaccaaccagcttgtactacagatttttgtttaaccagtcttgtgccactttaattgcttgtgccacattttctggttgggaacctcctgccattgccatatctggacggccaccgccttttcctccaacttgttgagccattaaattaacaagttctccagcttttattttggcggttaaatcatttgtcactccaacgacgagattaactttttcatctaatattgatgcaaatgcaattacgcctgatccgagttgattttttaaatcatcgaccattacgcgtaatgattttgtttctataccatctaattgttgtgcaataacagaaacaccgttgattttgaccgcactttttacaaaatcagaaccagcctgcattgcggctttttcttttagaccttgtaattctttttccactttcttcgttttgtcttgaagttgttggattttttccactaaggtatttacgtctgattttaataagtctgcgctttgggtcagaatgcgttgttgattatgtaaccagtcaatggcattttgacctgttacagcttcaatacgacgaatgcctgcagccactgcgttttcagtaataattttaaataaaccaatatcgcctgtgcgttttgcgtgaataccgccacacagctcaattgagaaatcgcccatcgttaatacacgaaccttatcgccatatttttcgccaaagagagccattgctcctttcgcttttgcggaatcaatatccataatatccgtttgaactggaaagttagcgcggattttttggtttactaatgtttcaatttcactcaattgctctttggtaatggcttctggttgcgcaaagtcaaaacgtaaggctttatctgaaacaagcgaacctttttgcacaacgtgtaaacctagaatttgacgtaaggcagcgtgcaataagtgtgtcgctgagtgattgagtgatgtgttgtggcgacgtttagcgtccacaatcgcattcactgattgtccaacttttaaacttccttgcgttaattccccaatgtgtccaaatacttgcccatatttttgggttctttcacataaaggttacaccttgtgtgcttaaatatccgctatcgcccaatctggaccaactgtgattctgcataaaaatggcgtattttcctaaaaatacccggccccggcacttgacctacttcggnatctttccactgatttaccatcatagaaaagtgcggtaatttttgcctgagattctacttcagtatagccttcaaacttagtttcgccatctacacgaataacgctgttgtagtccacaccaaactgggctcgctgcttgagcacgagtacgttgtgcttccatttcacggtcaaacgcttgttcatcaatagtaatgttacgctcacggcatacatcagccgttaaatccaatgggaaaccataagtatcataaagtttgaatgcaacttcacctgaaagaatgccatctttcacttgagaaagtgcttcatctaataagctcaagccacgctctagagtacgagcaaattgttcttcttctagacgtaatagtttttcaacatttgtttgttttgcttttacatcttttccagcttcagccattacttcaattagagtgggcacgagttataaaaaaaaggattctttggcacctaatagatgaccgtgacgaactgcgcggcgaataatacgacgtaagacataaccacgcccttcatttgatgggataacgccatcggcgattaaatatgcacaagaacgaatatggtcagcaataacacgtagtgatttgttagttaaatctgttgcgcctacaattnccgccgttttgcgatanagggtaccgaggccgatattcgtttaccag

SEQ ID NO: 253 - DNA, 1379 bp, H. influenzae
  misc_feature (1286)..(1286): n = a, c, g, or t
  misc_feature (1305)..(1305): n = a, c, g, or t
  misc_feature (1308)..(1308): n = a, c, g, or t
  misc_feature (1318)..(1318): n = a, c, g, or t
  misc_feature (1326)..(1326): n = a, c, g, or t
atccccgtatttgatactgaatttggcacaatggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaataaacaggatttatttccataaatgacagaaacaaatcctgaaagtagatatttctcacttctttaaaggcagtataaccttactgccttttcttctttcatttgaacaattaacgcattgttacaaattcctctgaacctgttggatgaattgccaccgtattgtcaaaatcagcttttgttgcgcccattttgattgctactgcaaatccttgaatcatttcatctacaccgaaaccaataccatgtaaacccataactttttcatctttacccacacaaactaatttcattttgcacggttggcgatgttgagttaccgcagtgtacatcgctgtgaaagaagatttatatactttaacattttctgcgccgtactgctcaatcgcttgcggttcagttaaacctacagtgccgataggcggatggctaaatacaacggttggaactaaactgtaatctaaatattcagtcggtttattattaaataaacgctctgaaaggcggcgacctgctgcaactgcaactggtgttaattcaataccgttttcgataatatcgcctaccgcataaatgcctttcacattagtattttgatatttatctactttgacatagccgtgttcatttgtttctacacctgcattttctaagccaattttatctgtcgttggaacacgacctgccgcccaaataacgcaatctacggtaacatcagattgaccatcacattttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctgtttaatacgccagaaagttcaacagcaatatagcctgcaccaataacacagcacgttttggtaattcggttaatggcaagaanccatccgaatcaatgcgtnatncttgcctttnatattggnacgatatgggcggccccagttgcgataaaaatgaacttgcggtacttgttttt

SEQ ID NO: 254 - DNA, 1218 bp, H. influenzae
ttttgtatagacaagtcagcacctaatactatttcatgacgaagatcgcctttttctttaaaaaggcaaaaataatgccattaatcaaccatgccagtaatgtcgccaccaataaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgccgcataaatcgtatgtccagaaaggaacgaataccccgtttcattctcataatgatgaactaaccaagctggtgtgatagcatccatcgaataaaaattcttagctatttcagcacgcaaagtgcggtcatttttataaaagttttcaggcgttgaatgagtttgctcagctagataaacggtaaacggacgaggttcttcaaataatgcttttgcccctgtttttgccgcttgagttgcaataactgaaatccccatcacaattacgcctaatagccattgttttggatttttaaataaaaacgcaaacaaaagcgtaaataacacacaggtaatcaacgcataaggtacgctacccgtttcagtgagcaaataaagccaataatcagcttgagttaattggctattaccatgccattgataggaaataccccaaataaaaaatggtacaagacaaagtaataacgtatataatgacagccttttgaacatgctcgccccttgataataaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtccttatttatcatcgtgaaaaggccgcggaattggcttgatcaaaaaatatccgggcttactttttacaagataaaggactgttaccatcgatacctatcttgcttttaggtttaaagggattgaaccaaccctt

SEQ ID NO: 255 - DNA, 1991 bp, H. influenzae
caatgaagcaattcagcaactttgttatagttatgaaaatacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtagtcacaaggcaaataaaatagacaatattgaaataagatttttgataaaaaagaaattttttgctggaaaaatggtcccccctaccggacttgaaccagtgaccaagcgattatgagtcgcctgctctaaccgactgagctaaggggggagagtgcggtaattatagagaaataatcacttgaagtctataaaagaagggatgattgacgaaaaatcaaccatccctttttacattattgaagcactgaaatatcagctacttgtaagaataacccttgtaacgtatttaaaatcgctaatcggttttggcgtagtgctggatcttcagcatttaccatcacgttatcaaagaaactgtctactggcgcacgtaagtttgctaatttatccaatactgcggtgtaatcgccttgtgcgataagcggttgtacttcagtgcgtaatgccagtaccgcttcagcaagggctttttctgctggctctacgcaagcggttaaattgatctcgccaattgccgcacctgctttcgctaagatgttgctaacacgtttatttgctgctgctaacgcttccgctgaatctaaagtacggaagtgtgaaaccgcacgcacgcgcgcatcaaaatcagcagggcgagttggacgacgtgccaataccgcttgaattacatccaccgcaatgccttcatcttgataccatgcacggaaacgaccgagcatgaagtctactacctcatcaaggattttttgttttggaactaaatcatcaccacgtgtaaagaatgaaacataaccttctgggtattcactaaatccacctcttgttttggcaataggtgcattacgtagtctttcgttatcaagttctttatataaatcaaatgctttgctaataatgtcattcagatcaagaggcaaatttttctcaacgataatacgtaatgcacctaatgccgcacgacgtaatgcaaatgggtctgcgctaccttttggtgcttggccgatgccgaagatacccgttaaggtgtcaaatttatccgctaaagcgaccgcacttgccactaaagacttaggtaattcatcacccgcaaagcgtggcatatattgttcgtttaacgccactgccacttcttcatcttcaccgtcgtgacgagcataatgcatacccattacgccttgcgtatcagtgaattcgaataccatgttggtcatcaaatcacattttgacagtaaacccgcacgttttgctttcgcttcatctgcgccgatttgttttgcaatttcgcctgcaagttgttcaatgccggtcagttttgctttcatgtgccagttgttgttggacacacggttctaacgtgtaaacgatcaccagttttgtttaagtcgttttgaaaaaattccgatcggtaacgtggacaacattttttgtccttcaaaatcgggtggactttg

SEQ ID NO: 256 - DNA, 1736 bp, H. influenzae
acttcatcgtcgtgaatctgttgaagtgtcaaggtctgcatcagtaagtaatatcaacgaccgttagataaaccgattacagatcgcttggaagcatttaagaaaaataatttttttaatcctgcacagcgtgaagaaaattaataagtttcagaaaatacctagtaaatgaaggtagtagaatgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatttaattgttttattgttgaaaaagctatatttctggtgggaagtatagcttttttatttcatctcgcgcttaaatatcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagaactcgtattgaccccagcagtctacttgcagaataaacttaatgaacaacgtaatcaaaatttacatattgcttttttaggtaaaacgtggttcttattctaatttagctgcacgtaattatgctggctcgtatcaaaacaattgagactcagggagggcgcctttggatcagatttgaaaaaattcaaatggaaaactgtttttggggttggcctttaaaatacactcggggcattaagggaggttaattacctcactact

SEQ ID NO: 257 - DNA, 1792 bp, H. influenzae
  misc_feature (1529)..(1529): n = a, c, g, or t
aatggcttggtgttaaagaatgttcgttatcaaacccgctgggattgagacacatattgcacaagcacgtttacagctcgattttggttgtttgctttcacgtgaagtttgtttacgagacttcaccttaaataaaccgaccattgcgattaatactgcattattgcctccatcggcacctgataattcaaagtctggctcaatgaagcgtatttccttgccaattagtatcaatgcagaaaatttggtggtgcaagatttatctgtaaacattgatcagactaatattacgcttggaaattttaaaagtgcggtaagtttaaataatgaaaaaggcttaactattgcgccgactgaaattaacgatatttcagtgattgcaaaaaaattgcccgaaggtaaacctgagctgaaagccaaacagccgaataaacctgtagattgggctgcgattgagcaatctttaacgcctgcttttttaggcaatgtatcagacataattcttccttttgatttacatattcctgaaatttcaggcaaaaactggcagtatcaagcagtgaatgaaaaagacgaaacgcttcaatctgttgaaatgtctagtttaattgcacaggcggataccgtcgataaccaactgcaattacaaaaattagcggtagaaagctcgttgggtaatctttcttcacaaggtaaattacaactcgatggcgatatgccgctagatttaactttaaaatcccatttggagccgttgaaatccgctggaaaagaaattctgccagagagtgatgtggatcttacgctttcgggatcattgaaaaaatccaccgcactttctgtgaaaacaaaaggcgtattagatgctgaactgaatggcaacgtgcaattagcacaagataaaatgcccttaaacctcacattaaacgtggcaaaaggacaatacacttttgtaaacacaatgacgccactcaaaattaatgatgtgacgcttaaactcacgggggatttactgaattatcacgccgaatttaagggcaatgtggcaggaatgaattatattcccgcatctcaagtagactttaatgccgacggcaaactttatgaaataaccgtaaataaattggggatagcttcattagacggtaaaagtgaatttgtgggtaatgcaaattggaaaaatggtgcaaactgggatattcaagccgatttagaaaaaatgaatattggtttttttgttccagttatgcctgccatattatcgggtaaattacattctcgcggttttgcggactctcaaggttggcaagtggaagtgcctacagctgatttaaatggaatattgtctgcaaaaccaattagcttgaaaggttctgcaacgcttaatcaaaatgtacttctaaccgtgcctgatttacagattagatatggcgaaaattatcttaaagccagtggcgtattagatgatcattctgattttgtgctagatatagatgcaccaaatttacgtggtttatggtcagatttanaagggcgagtagcgatttctggtcaaattacgacacctaatcttgatcttgatttaacttcatccaatttacatttacaaggttttcagttagctaaagcaagtataaaaggtcatataaacaataccccactctcgagtggaaattggatattaaatcagaaacacttctttatggcgaaaatattaaactccatttacttgatccttgatttatccgggcgaggaacaaatcccaaatttttcctaaatctcaagccgagc

SEQ ID NO: 258 - DNA, 1346 bp, H. influenzae
  misc_feature (1058)..(1058): n = a, c, g, or t
acccctctacttcttttctaaattgagtcattttaatcacctttttgggttagttaatttatcgtcattatagaaatttcaagaagaaaaaacttgatgaagatcacattttcaaaaaatgctctcaagacatattttcatttttcggattagtttttttagggaaaaatgttctatctatcaatcttacacagatttcaatagcctaccaattttctcaaataatttctgaatttgctctgcacgacacccgagtacccgcaccattaaaccatattcattgagttgtgatatgcctatcagtagatctttttcttccgtactttgttgctgcaaggcttgcacctgttgtttgatttccgcattatttttcgccaaatttagataagtcagcgaaccttgatgggaataattttccatctgactcaaagcggtaagattcattttagacggcagccactggatacaatcactgacaagcggtcgttttttgccatcgtctttcaaagtataaatcttcaaatgggaagaaaactggcggaaggcaaaacgttcatcattcaacacccgcccaatcgccacgatttcaccgtaaatcagctcgctttgttcgcccatttcaatctgggtttgctgcttaaaaacggaatctttatgtaacaccaacggatgcggcaaatagaataaacgactgttttccgcaagcaaaatatgggttgtttgcatcgcactgtcgccttcattcatcgcctgcacccgagtaaatgcctgcgtatttaaagaaagtgcggtcaattttgccaacgaaatatcaatctctaacagatcgcccgccagcaccccaggggaggaggacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtagggggctaattacattagccccgatatttcaccaataattgggcanatgtaatttgcccctacgattaacgaaccaaagatgcaggttcttccacattcttcaacacgcatatttttcgatccaaccgatcacgccatccagattttcttttttcatcagggtagtgaaaataaacggctgaccgttacgcatacgacgagcatcacgttccctgacgcttaagttcacaccaccgaagggagcagggacagttttgttgatcaccagtaatctgaacgagggatacccgccccactttacgagggaattttttcccctggaccacgtcaatca

SEQ ID NO: 259 - DNA, 1753 bp, H. influenzae
  misc_feature (1333)..(1333): n = a, c, g, or t
  misc_feature (1605)..(1605): n = a, c, g, or t
  misc_feature (1627)..(1627): n = a, c, g, or t
  misc_feature (1733)..(1733): n = a, c, g, or t
aatagatattttcaagattggggaacagcaactcaaaacaccgggtgagaggtcaacggggagaaatgtggcaagaagatataaaagatgttattatcggaatccggcgacaagcacgaacagccccggaaaaaaagatcgaagcgtctgcatgaagccaaaacaagtaatgccacagaaaacataagacgctataaagatttctactccagtgttcgatcctttatagataaaagtgtcaatgcagaggtggcactttcaaattttgcggaattaagaaattaattcagggatgacagaatgaataagaaaaccgtgtgtcacaaaatataacgatgtggatcttcaggtgtatcatgcccccccagccaattatgctgaaatattgctgcatagaatcgaccttgaagctctcgaggatctaaatcaatgcgagattgcccctggttttgcaagcgaaccgcagtgacaacatactcatcaagttgccagctgagtaatggagtagctcgcacaggcaatgcaggtaagagcgttttaagcggtgtaggaaggcgatgtgaaacttggcgcacaccttccaaaggctcaactgaacgtaaaggcgcataaaacatttgtgcggcataacgtgttaatgcagctggagcggggagtgccggacgcgcatttggcattggttcgttatatgcatttgcatcttggccataagcagttgtttgtttttcaactttattttcataaacaaagcgaattggctcacttgcattggcaacagaatgcttcgcttgcacatcaagtaagattatttctccagttgcaacatccataagctgcaagcgtgtttttgggaaatctgcagttgcttttaaataaaccgcaccgccagttgattgaatgcgaagcttgctatctaattcaggtggataacctacttttacatttttatctacgaatagaatacgttctttttcgatttgtaagtcaataggtaacggtttgcgcgcccatttcattaacacatcggcagatgccgtcattggtgaaaagataaaagccgcgcttagtaacaaagtgagttttttcattattggttatccccttctctaaattcttttgcttctaaacgtaatggaattgagctgtagcagttaaatcccaatccccaaggattgttctgtaaatctgtttccatgcgcacgatattgaccgggaagcgggttaaaacacgtttaactggtcatctttgaatactcatctacacttaaatcaagattaaccgtccagctatctggactatgcacaataacgctactgtctttaaatccacgtnccacaatttcataaacaccacgtgcacgttcacgtaattcaccgttagataaacggcatagtaggctttcttcaaaattcttggcaacttggcgaaataaggctttatttctttcatatttattttggattcttcctcgccatctccatccagcggtttaactgctgggaggttggataagcaaagcctaaccgcgtgatttttggcctttccaccaggggccgtgacttcccccccggaaattcggcgggttaaaatattaatcacttggngcgggaaaataaggggcttagnccccaaccattcccacaatgccccgatagcatttccccggccagatttgcgattttttagagaacaatccctttaagacccctaaaaactctgttatttgaccggngctcaaccaggcctggggga

SEQ ID NO: 260 - DNA, 1476 bp, H. influenzae
  misc_feature (1439)..(1439): n = a, c, g, or t
tgcattaaccgtgattattcaaaaattactcacctttgttcattcaactctttctttgattattacaacgattctttgcggtctaacaatgattggggttacttgtaatgggcaaatttctattctaattccaggagaaatgcttaaaaatgcgtatgtagaaaaaggattacatccaaaaaatctaagtcgaacagcagaagactccgcaacaattattgaacctattttgccatggactgccgcaggtgcatatatggcaggcacattaggtgttgcaacattgtcttatttaccttgggcaattttatgttggagcggtattatctttgctattatttatggtgcaagtggaataggtattgcgaagctaaaaaaataaatgtggtattggatataaaaatggccagttattctggctatttttatcttgaagctaaatatcttttctattataacttaaatagcaatttcccatagataaggatataaaatgacggaacaatactacaaaattgccctcttatttaatgcaaacaaagtatatgatcggcaggtggtggagggtattggacaatatattcaggcatcgcaatgtatgtgggatatttttgtagaagatgaatttatctatcatactgatactattaatcaactttctattgatggcattattgcagactttgatgatccaaaaactgttgaattattgcaacacactcttattcctactatagcagttggtggatcttataaacaagctgatttttatccgcactttccttatgtagcaacagataatatggcattggttgaaatggctttatctcatttacaggagaaaggactgtcacagtttgcattttatggtttgcaagtaaatactcataagcattggtctatagaacgaagagatgcttttgtagagttgatggagaaaaatcattaccctatttacctatatgagggtgtgcaggttcatgctcaaaattggttggaagagcaacaaaagctaattgtctggttaaaatctcttccttctcatactggtattattgctgttacggatgcgcgtgctcgtcatttattgcaggcttgtgaatacagtaaaattgctgtacctgaagagctttgtgtggttggtattgataatgaagaattgatccaatatttatcgcgtatgtccctttcctccgtagaacaaggcacgagagagattggttatcaagctgcgaaattattacacaaattactcaatggtcaaaaagtttcacatacccctattttaattccaccgattaccgttcactctcgaaattctacagattatcgatcattaacagatccgcttgtcattcaagcaatgcattatattcgtcatcgtgcctgtcatcgaattaaagtagaacaagttttagatcatcttgaaacctcacgtnctatactgaacgggtaccgagtccgaattcgataaca

SEQ ID NO: 261 - DNA, 1231 bp, H. influenzae
acagaagttggcacattacgatatgccacaatatcatttacatttttaccaaattcagcaatttgtccgccaaaaatgatgctttcagggtgctgttcaataaacgctacttgcttttcaaaacgatcaggcacgcaaatatcatcggtatccatacggaaaacccagtcataagtacaatgcaataaaccttcattcaaggctttgcctaatcctcgattttgcggcaatttgactaattttaatggcaattttgtttcaaattctgtcacaacagattctaattctggcgttactacgccatcaaaaaccaatacaatttcatctgcttgacgagtttgtgcaacaagactttcaaaacactcccgcaagaattgaggattttccttaatatataaggacattaggactgaaaatttcattttattttcccaaccgttttaaattaatggctaattttggcgaaattaaaataaccaaagtaataataaattgcctaatgctttttgttttcttaaaaatatcaaaataatattttgccgctttacgcgataaattcatgatatggggataagccaaaatatagctcgcgttaatatcaaaattacgagcttgctccaccgttttcacataatgctcgcgaatataatcaatggctttttgcgtattagtggtatccgtagacacacttgagcgtttagtatggaaagtacagtaagttagtggttcattaattttataaggagtaaaacttggctcttgtaacagttttaacaagaaatcatagtcttccaaagaacgaagtgcggtggataatccacctatttttaaaaacatctcttttttaatcgcaaccattggcatgccaccaatcttattggctaacaaaatacgttctgtcgagatttcttggggttcaatcggttgagtcacataagtaaacccttcattgaccatttcacatttagcaggatgataaataaaattaatgtctggattttgctcaatcacttgtagtattttttcacatttttctggcataaaacgatcatcatcatcgagaaaaagcaaccaatcgccctttgatgtacgcgcaccaacattacgactttccgctgcaccttgattggtttcgttacgaatcactgtaactggaaaagaataactttgttcaacaactacttctctttggagcaatcatccacaataatcacttcaaaattactcgatg

SEQ ID NO: 262 - DNA, 1782 bp, H. influenzae
gccagacttggctggcctgccaggtcgactcttataggatccccactcgcgctttggcggcagcttgatgatctaagctagacgcagattgtgaaacgcagtgcagaaaaaatgaaagggaaaataaccgcacttagttgtttacttattgtttgcatttttctccttttaacaggggcagtcgaaatatttaatatgctttaatttgtatgaaaacatagggcatgtgaacttgattaattcacatgcctagaatattaattaacttctgttaccccaatattttgtccaaattggcgtttcattgccgtacgtttagtacgatcgatcacatctccagctagctgtccgcaagccgcatcaatatcatcgccacgggttttacggataatcacggtaaagccatattccattaatgttttttggaagcggtcgatacgcgtattcgagctttttgcataaggtgcctctgggaacggattccacggaattaaattaattttacaaggtgtattttttaatacttctgcaagttgatgagcgtgttcaatgccatcatttacatgatcgagcatcacatactcaatcgtcactttgccgtggtttgcatttgatacatttaaataacgatttactgagtcaatcaaggttttgatattatattttttgttgattggcacaatttcatcacgtaattcatcatttggtgcatgtaatgaaattgccagtgccacatcgatcattttgctcaaattatctagtgctggcacaaccccagaagttgataaagtgacacgacgttttgataaaccgtaagcaaagtcatctaacataatttccattgcaggaacaacgtttgcgacatttaataagggttcgcccattcccatcattaccacatttgtaatgggtctaacgccagttacgccaaagttaccaataattttagaggctcgccatacttgaccgataatttctgaaaccgttaaattgcgattaaatccttgttgtgctgttgaacaaaatgtacaagctaaggcacagccaacttgggaagatacacaaagcgtcgcgcgatctgcttcgggaatatacacagtttcaacttgctgctcgcccacttgcattgcccattttatcgtgccatcggctgaacgctgttcaacggcaacttctggggctttaatttctgcaaccgctttaagtttttcacgtaattttttattaatgtttgtcatattgtcgaagttatcttcgccaaaatgataaatccattttactaactgatctgctcggaatggtttttcgccgagttctttaaaaaattcgcgcatttgttggcgcgttaaatccattagattaatttttttagcgggtgcatctgattgcacagacaataattctgacattttagcctcgttattacacattgtggcgatagcgttgtgcaggtgttttatcaaaaactcacaacgaaaaattcgcaattaaaaaatgaacggcgattgtacagatttgtcattgcataatctagcggaattgaaaaacgatggaaaatcttaccgcacttttttgcgatctagatcgcaaatatttccaattacagcgtaaaaagtgcggtaaaatgtgagctcattttttaaggtgtccaataatgtttaaaaaagctttatttattttatctttgtgtccttcttttttgctggcacagtcttatgttgtgtatgattttacccataatcgagtattggaaagctatgcgcctgatagtatcagcctatt

SEQ ID NO: 263 - DNA, 2741 bp, H. influenzae
atgttatacgaatatcggactcggtacccatatcagcctcatcatcgcctacaatgcgataagtgacttcttcgtctgtatttgtatttacaagtacaactgttgcaccaaaaatcactttaccattatttggcatttttgtgacatcaataatttgagcattaccaagtttaccttcaatctcttgaatacgcccctcacaaaaaccttgttgctcacgcgctgcgtgatattctgcattttcttttaaatctccgtgctcgcgtgcttctgctatggctttaataatttctggacgacgtacattttttaagaaatccaattcttctcgtaattgttctgcgccacgcacagtcattggaatttgttgcattgtttttccttttactaaataaaacaaaaaccacagtaaaattctaaaatcttactgcagtattatcaaaaataaacttgaaatgagaaaatgatttactcaatttcattcggggcttattattgttcgtctaaaaaaaaatagcaaccataacaaacctaatatgaaaaaattatcttcaatttccaccgcacttggttcctttttactttcagtgagttttagcctaccaactttcgccaatattaatgtttcagatttaacacaaaaattgcctgaaggctctaacgcaggtgttattgctaaaaatatcaatcaaaatcaaataattgctgattataatggctcaacctttatgctgcctgcgagtaccaaaaagtttttacagccgttgccgctaaactgcattagcgatcaattccaatttgagaccgcacttttgagtaatggggaaaattcaaaatgggaatttagatggcaacttaatcgtgagtttcacaggcgatcctgatctcacaagaggtcagctttatagcttacttgcagaattaaaaaaacaaggcatcaaaaaaattaatggcgatttagtattagatacctctgttttttctagtcacgaccgaggattaggttggatttggaacgatctcacaatgtgtttcaactctccaccagcagctgcgaatattgataacaactgtttttatgcggaactagatgcgaataaaaatccaggtgaaatagtaaaaattaatgtgcctgcacaatttccaattcaagtgttcggacaagtttatgtagcggatagcaatgaagcgccttattgtcagctcgatgttgttgtacacgacaataatcgctatcaagtaaaaggatgtttagcccgtcaatataaaccttttggcttaagttttgccgtgcaaaatacggatgcttatgctgccgcgattattcaacgtcaattaagaaaattaggtattgagttcaatggcaaagtcttgttaccccaaaaaccacaacaaggtcagctattagcgaaacatttatcaaaaccattacctgatttattgaaaaaaatgatgaaaaaatcggataaccaaattgccgattcattattccgagcggtggcattcaattactataaacgccccgcctcctttcaattaggcacattagcggttaaatccatattgcaaaaacaaggaattcgttttggtaatagcattttagccgatggttcgggtctatctcgccataatcttgtggcacctaaaacgatgctatccgttttagaatacatcgccaaaaacgaagataaattacatttaatggaaacttttcccatcgcaggtgtagatggcacgatcagtgggcgaggtggattaattagcccaccattagtgaaaaacgtgattgctaaaactggttctttgaaaggcgtttataacctagctggctttatgacaaatgcgcgaggggaaaaagtggcatttgtacaatttattaatggctactcaacgggcgatttagaaagcaaaacaaaacgtgccccattagtacaattcgagcgtaatttatataacgaactctataaatattaaggtgctgtagtagataacaactaaaaatcccatttaggttagaataaaccaatgagaaaaagtcgcttaagtcagcataaacaaaataaactcattgaactgtttgtcgcaggtgtcacagcaagaacagccagtaaattggttaatgtaaacaaaaatacagccactattactttcatcgattacgcttactcatttatcaaacaagcccacatttggaaatgtttgaaggcaaaattgaagccgatgaaagctatttcggcagtactcgaaaaggcaaacgtggtcgcagtgttgcagggaaagtcgcggtattcgggcttctcaaatgaaatgcaaggtttataccgtaatatgttcctaatgtgcaatcagcaacattattgccaattatccgaaagaaagttaagcctgatagcattgtgtacacggatacctttcgtagttatgatatgcttgatgtcagtgaatttagccattttcgcatcaatcacagcacgcattttgctgaaaatcacaactacataaacggaattgggaatttttggaatcacgcaaaacgccatttacagaagtttaatggcattcccaaagagcattttgagctgtatttaaaagaatgtgaatggcgttttaacaatagcgaaataaaatctcaaatttccattttaaaacaattagttaaggggagtttggtctagttatctagtacagcccctaaaaaagcggggtcctccaagagtcgacctgcaggcagcaagtatggc

SEQ ID NO: 264 - DNA, 1630 bp, H. influenzae
  misc_feature (1519)..(1519): n = a, c, g, or t
tgcttgatgccgtccgagtgtattgggcgagcggcgaagatgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagctatagcaagttaagcaacaccaggaaaaagactatcagtgttaatgctaataaatacactaaggataactatagacagatacttttacgcctaaagccagatgtagcagatatgtttgattcaatctgtgaaaaggaaaaatatcaagggcggaaatgctaaaaaaacttctagaaacttattcatataacaaaacaacaaaatggcagagntgagccctgccatttttgtttataattctcagaatccttaaaccgggttttttctactctcagaacattaaattttcctataataataacctttatctcgccacggtgaac

SEQ ID NO: 265 - DNA, 1558 bp, H. influenzae
catttgaaataaataaacattgcggatttgattatctttaatcttatcaataaataacacaacgttattattgttggtagaaataaactgacctgaagacagcacgccaacggttggattagcctttgcatcttccaccatattcacttgtttttgaattgcccaaggcgaaagccataatgcgttataagcggcaatacctgccgttaataaaatcataatcagtgccactttaaccaaaatccgttgccccacaccgcacgcgcgcatcactgtgattccactttcagcgtaaaggcgaccaaaactcagtaaaatcgcaatacctacacatagtggcaacatcaactgcggcccatgtcggcattcctaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcacatgaaagccattgcacagttgaacttaccatt

SEQ ID NO: 266 - DNA, 1765 bp, H. influenzae
atttaatggatgataaataatggaatataatcttctcctaaacgcccttatttattacgcgcctattatgattggctagtagataatagttttacgccttatttagttgttgatgcgacttacttaggtgtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggattaagaaaaaacgcgatgaaattatcatcgcgtttatttttataaattaccttgttttgcaataaagttgagaattttttcttcaatgccttttgtatccaatcctaaatctgccaatgcttcttgccgtgtcgcttgtggaataaaataatctggcaaaccaagttgtaaaagtgcggttgattttcctgatgaatttagtacttccgcaacagcagatcccgctccaccttgaattgcattttcttccaatgtgaccaaataatcgtgagtttgtgcaagcacattaatcatttcaatatcaatcggtttcacaaaacgcatatcgacaaccgttgcattgagtttttctgataactctaaagcggatggtaatagagtaccaaaatttaaaatcgcaattttttgaccttttcgaattaaacgtgatttaccaataggaagcatttctaaaggagtaagttttacaccaacggcatttccgcgagggtaacgcactgccgcaggttttccacattgataacctgtatagagcatttgacggcattcattttcatcactcggcgtcataatgatcatatttggaatgcaacgcataaagctaatatcgaatgcaccttgatgtgtagccccatctgcgccaactatccctgctcgatcaatcgcaaatagcacggggagattttgaatggcaacatcatgaattaattgatcgtaagcacgttgtaaaaatgtcgagtaaattgcgacgacaggtttatatccgccaattgcaagtcctgtggcaaacgtgacggtgtgctgttctgcaatcgctacgtcaaaatattggtttgggaagcgttgggaaaattctaccatacctgaaccctcacgcattgcaggtgagatacctataattttggcatccttttctggcatttcacatagccaatcgccaaatcttccaataagccggttactttgcgcctggtccattttccctgatgcgatccacttagcccctcccggatacctccgctatctcttgtgcggagtcgatctcttattttgtttcggctttttgataagggtttgccgcttgtactaaacaggcctgtccgatcgggtgaccctataatgtcctatttttgctcacggctcttatcccctagtatgttatgtcgtctgcttgagctcgcgccctgtatttatgtttctgcacgttagctagacgcacgtgtttttttttcccattgtttatcctccgacccgcggcgttgcgtgccttctgtcacccggctcggcttgctgtctgg

SEQ ID NO: 267 - DNA, 1720 bp, H. influenzae
  misc_feature (1684)..(1684): n = a, c, g, or t
  misc_feature (1692)..(1692): n = a, c, g, or t
ctgcccgcataaggataagtccctgcaattgaactcaaattgataatctgcccgtgattacgagcgaccatatttggcaacacaaggcgagtgatagtaaccaatcctttgatgttggtatcgatcatctgataccaatcttgtaaatccgctttatgtgctggctctaatcccaaggctaaacctgcattattcactaataaatcgaccgcttgccaaccttcaggaagggtatttagagcgttaattgtgacttgttcatcacgaatatcaaaggcaagcggtagaaaattattgcccaattgtgaatggatttctgccaatcgatctgcacgtctacccgtgccaatcactttatagcctgcttcgatcaattttttacagatcgctaagccaaagcctgcggttgcacctgttactaatgcagttgtggttctcattttttctcctaaatcttgagcttatttgtactattaaagtagtacaaataagttttgattgcaagcaatttcattttaattttaaaaatgtcattaaatgaattaatttaacaatatcgcaaacttttgcttgatggtataatctgcccaatttttatttcaactgattgaggttaatcgtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaataataaaatcttaaatttaaattggggatcccnctagaagncaaaccggcaggcatgcaagtcaaaggc

SEQ ID NO: 268 - DNA, 2020 bp, H. influenzae
tgttatcggatatcgggctcgtacccggacctcaaaattggaatattcggggtaagaagaatcccatccattattggttcccgagggaaaaacggcggttaaatggaccgcctttagggggcttacacagggttaaaataaaaaaccaacggcggaccattccggggacaacacaagtccttattgggggtcgttcttataacattcttccaccaaattaaaatccacagaatccaaattctgcacacagtgaccgtcgttacgcaaatattccatctgaggttgggccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaattaagttcaacgtattgttgttctaactgtataaaacaaaaccccgcaaattagcggggtttttaaacaagtccaaattattttgtgcttggaattttgaaacggctgttgaaacgctcgacacgaccaccagtatcaacaacacgttgtttaccagtgtagaatgggtggcagttaccgcacacatcaagattgatgtctttgcctaaagttgaacgtgttttgatcacattaccgcaagaacaagtcgcagtaacttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattgggtgcaatggtttgcacgcgaactaagcccaaatgcgatctttgtccgttaaatattgattgtttggcttataaaaatacaaactgggaaaaatttccagctaaaaaacctataaaagcgatgccagaaaaaactacctattttttattttgtcgaaaatggcaaagatgtttggaacagcgagaaaactcaggattatggggcggattattttgtttttcacaatttgaagataatcctcgttgcttcattttttagcccagaaaaagcccgcattatcagaatgcgcgagtttcgacaacatttagccttttctttagatattatccaattatgctgaaatggaagcgcttatgcgaaagcagctatttaactggcgaaaaggtggaagccaaaaatacaatcaccttcagggcggcaatatggatgacccaaacctac

SEQ ID NO: 269 - DNA, 1700 bp, H. influenzae
  misc_feature (1644)..(1644): n = a, c, g, or t
gcgggagagccgccatggacaccgaaccagaacagtcactgaatgttgatatacgttattaatgcggagtcccgtggggtgcattttgttccgggcgtgggtggctcccagaatttaggggtcccccccagattgcccgcgccattctgccaataacagggatcttaatgtcttcgccttcatctactaagcgttattgtactgggatcgcaatattccagaaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgctcccgccgaaacctgtggtattctgggaagctatctcgaatatgtcccccctttattaagatcctcacccccacctttgttccccacgcactgtttttcacttttttacacttcgaaacgcacccatttggtccttttatccgtccttattccccttattccgcttnttccatccccccttatttccgcgccatttatagctctttatctcctctattttctc

SEQ ID NO: 270 - DNA, 2264 bp, H. influenzae
  misc_feature (100)..(100): n = a, c, g, or t
  misc_feature (1932)..(1932): n = a, c, g, or t
  misc_feature (2236)..(2236): n = a, c, g, or t
cagtgtacccgaaatattacctacagcaagagtatctccggttgcagtaagtgttactccgccagacttggactcaattccacctttaatgtcacctgtnttagcggttactcccacgccacctgtggtcgcattaatggttgtgccttctttggttgttacatttcctgttgtggcagagatatttattgtcttgtgagaagtgatgttattatttactgccacatcttttgcggaaatagttaaaccagcgttgttaccattactatcgccagcagcattactattaccattagacgtttccacttcgctatttagtgttacattgtgattgccagctgagatttttgaatctttaaccttgtcaaagattactttttgagcaccagcattaccgctatcactgctagccttgccaataattaaatcactgttatctttagctgtaatttctgctttatgaaagcctgaaatgtttaggttgtttgttaattctagcgttttggttttaatggttagattggcattgttttctgtgcctgaatcagaattctccccattaacgcctgctttgattgttatctgcttggtaatattgactttatcagaagaaattgtgagattgccttctttttgcgagatattgccgccaatttggatttcggcattatttttattatccctgatgtttaagtcgccttttttattggttatatttccggtaataatggttttttgattagtgttagcgtgagtagtaatatttaaactaccttcattggtaatattacctagttttgccgcccctttttttacatcaattatggaggtgccgttgttggtaaaattgccggtaatgtttaggttgttattagtattaccattaaaagtagcatcgtttccaacagtaaaatcaccagatacatcaatagtatcgccagttgcaacaagcttaccttgagtattgatatttccagctacagctaaagcacccttatgatttccaaagtttgctgacgcaagagtaagatttgcacccttttcaacagttacatttttatcaaatttggttttagctttatttgaacctagggtgacattccctcctttaatggtaacattaccgtttacctttaaacctgtatcaagatgagtatctgtaccttcaatttctttaatggatacaaatgaattggttgcgtttatgattaaatcatttgctacattaaataaggttgtagatggcatactaccagtaatgtttagctgcgaaccttcggtaacattaataaatctagaggaaatgttcacccctggagttttgtagttattgctaagcgcattaaattttaaattaacaactcctcctcctttaacagtaatatttccgtcaaaattgacagcagcaattcttgaatttttaactggagatatcggtagggtgtaggaaatatcaactctagcaccttgttttacattgaaaatggtatctcgtgtaaaaccaatccctcctgtgttttttttgtctttagcattgtcatatcccccaactttaatcgcgtcttttattgatgttaaagaaaaactagaatcagaatcaacattaagctgcgtcaaattccaatatgtataaccctggcgatgaaaataagataattgattattagcagtgtgattaattgaaatatttacctgaatatttaacacaccatcaaatttgggctgagaaaataccttgatttcctttagctgtaatgaatttcaaccctctaccagttccatttagtgatacattattaaaacggaaatcttgaccactgcctgcagtaattacaccctgagcaacaattttagcatcacttgcagcacggcctttatcaccccctgccttttcaaaagctacagaacccccagcggtaatatttaaaaacncccataccaatcgtgatatttttgtgaacatcaacccagctacctgctttaatggttaaattaccattttgttctgaggtaatatcaccgttaatttcaactccaccttgttctgagtgtaacgttaatgttccattatgaacattaatatctgcagtaacatttactttctttttagcagaaatattaactccaatacctttagctaaagctgtagataatgttttgttattaacagtatgtttattatctgctagaattttattaggtgaatcgcctctatcggccttaatgaggggtctcntagagtcgaccgcaggcagcaagctggc

SEQ ID NO: 271 - DNA, 1410 bp, H. influenzae
tgatgaaaatttattacgtaaaaaactagcggaacaacatactcagattcgacgtgaatttgattctttagtttcagttgcttcgattattgaagaaagttactggcaacaagataatccagatgccatttatacctatcaacatttagatcagttagcgacaaaagccacaatagatgcgttggctcaaaaagccctaaaaaaatcaggcagatttgtcagcgtattaaaagcagctacttattagaaaataaatgaaatctcaatagatctgaaacagataaaaataacggtgatcgcttaaacgatcaccgttaaattgaactcactgtttaaacagtaaattatattggttattttcgagaagtattactcttcattcaataactttaattcacgacttcttacttgatttttcaagatttccgcaaattcttccacagtaaatgtacctaaatcagcacctttacgggtacgtacagccacttttccttctgcgatttctttatcgccacaaacgagcatataaggcacgcgacgtaaagtatgttcacgaattttgaagcccactttttcatttcggaggtctgctttaacacgtaaacctgcatcagataaggttttaacgacttgttgtacatagtcagcttggctatcagtgatattcatcacaactgcttgggttggggctaaccacgcagggaagaaaccagcatattcttcagtaatgataccaatgaaacgctcaatagaacctaaaatcgcacggtgaatcatgacaggggttttacggctattatcttctgccacataagttgcatctaaacgacctggtaatgcgaagtctaattgcactgtaccacattgccattcacgacctaaacaatctcgtagtgcaaactcaattttcggaccatagaatgcgccttcaccttcttggatttcatattcaagaccgttgtgtgctaatgctgctgcaagacctgcttccgctcgatcccacatctcatctgaaccgatacgattttccggacgagtagaaagtttcactgcgatattagtgaaaccaaaggtgctataaatgtcgtacaccattttgatacagctagttacttcgctctcaatttgatcttcagtacagaaaatgtgcgcatcatcttgagtaaagccacgaacacgcattaaaccgtgcaaagaacctgatggttcattacgatggcaagaaccaaattccgccatacggattggtaaatcacggtaagattttaaaccttgattaaaaatttgaacgtggccagggcagtcatcggtttaattgcgtattcacggttttcagattgagttgggaacattaatctgccgaatttgccagtgacctggtttttcccccatacgcgaaccatcataaag

SEQ ID NO: 272 - DNA, 1501 bp, H. influenzae
tgttcgattcggctcgttccctttgctcctaacgcaggagtttgatcaattcttcgttttctgttattgcgccaccacgagaaccacgatttgggcgatctaatgcttcaaaaacagaagcacttgaaataatgcgtaagtcattttgaagcactgccacatcaagcgatttatcaccaatgcttaatacgccttcgtgaatagctaaagggagttcttctagtgcttttttatgttcccagcgtgctaacgctgctttctcggctcgttctttacgtttttcagccgttaaggaggtagaaaccatatgttgctccattgcttatttataacttttattagcataatgctaaattatatttaagtaaagcattattttatgctttacattctcaaaattttcctctactattttattcaaggtctcaaaagccttatcaagaacggtaactcaccccgtcagcgtgatttttttatgcgtaaaatttaccttgtttgttttattgccattaagacttacaacgcataaaaagaaaattatcaatcaatgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttctaaaaacaacggaaaatccgaccgcactttaccgtgtggcggatttttacacctcaaattcacgaaaaaggatacattatgttcagaattctctttgcggtggcgttgttatgggcagcatacgaactcaatttaaaccaagattgcgatgggtatattgcgggggatttc

SEQ ID NO: 273 - DNA, 1235 bp, H. influenzae
  misc_feature (1196)..(1196): n = a, c, g, or t
  misc_feature (1202)..(1202): n = a, c, g, or t
  misc_feature (1221)..(1221): n = a, c, g, or t
  misc_feature (1226)..(1226): n = a, c, g, or t
ctatagcattacaagtcgcgaaaattaatgggcgattgcttgatttagaattgagtgcgttggagcgtgaaaataatgtagaaattattgcaagtcctcgcttactcactaccaataagaaaagtgcgagcattaaacaggggacagaaattccttacatcgtgagtaatactcgtaacgatacgcaatctgtggaatttcgtgaggcagtacttggtttggaagtgacgccacatatttctaaagataacaatatcttacttgatttattggtaagtcaaaattcccctggttctcgtgtcgcttatggacaaaatgaggtggtttctattgataagcaagaaattaatactcaggtttttgccaaagatggggaaaccattgtgcttggcggcgtatttcacgacacaatcacgaaaagcgaagataaagtgccattgcttggcgatatacccgttattaaacgattatttagcaaagaaagtgaacgacatcaaaaacgtgagctcgtgattttcgtcacgccgcatattttaaaagcaggagaaacgttagaggcgttgaaacaaaaaagtgcggggaaaaaataacttttttagacgatgaatttttttaattttcgctgtatccactgtcgtggcaatcttcatattgcaaaaaatgggctatgttcaggttgccaaaaacaaattaaatcttttccttattgcggtcattgtggtgcggaattgcaatattatgcgcagcattgtggtaattgtcttaaacaagaaccaagttgggataagatggtcattattgggcattatattgaacctctttcgatattgattcaccgttttaaatttcaaaatcaattttggattgaccgcactttagctcggcttttatatcttgcggtgcgtgatgctaaacgaacgcatcaacttaaattgccagaagcaatcattccagtgcctttatatcattttcgtcagtggcgacggggttataatcaggcagatttattatctcggcaattaagtcgctggctggatattcctaatttgagcaatatcgtaaagcgtgtgaaacacacctatactcaacgtggtttgagtgcaaaagatcgtcgtcagaatttaaaaaatgcctttctcttgttgtttcgaaaaatgaatttccttatcgccgtgttgcgttggtggatgatgtgnttactnacgggtaccgaaggcccgnaattncgaataaca

SEQ ID NO: 274 - DNA, 2035 bp, H. influenzae
  misc_feature (1998)..(1998): n = a, c, g, or t
  misc_feature (2027)..(2027): n = a, c, g, or t
cgtgcaatatcgcgtgcaaaatcctgcaaaaatctttttagcgtaacaaatgcagatgatagtttgaatcaagcgacagatagtgcattacgttatgttattgggcatatgtctatgaatgatattttaaccacaggtcgctctgtcgtgcgtgaaaatacttggaaagctttgaatgaaattatcaaatcctatgatatgggacttgaggttattgatgtgaacttccaatctgctcgtccacctgaagaagtaaaagatgcgtttgatgatgcaattaaagcgcaggaagatgaacaacgttttattcgtgaagcggaagcctatgcgcgtgagaaagaaccgattgcacgcggtgatgcacaacgtattcttgaagaagcaacagcttataaagatcgtatcgtgttagatgcaaaaggtgaagtggaacgtttgcaacgcttgttgccagaatttaaggctgcaccagatttactgcgtgagcgtttatatattcagacgatggaaaaagtgatggcaaataccccaaaagtaatgcttgatggcaataatggtaataatttaactgtgttaccgctagagcaaattatgggcaaaaaatcggtaacaagtgcgccaagtgcggtcaattcttcgcctgcttttactgcaccagaacgtcaaaattcttatcagcctcagccgactaccgttgcgccgattcgtcaagggagatttaactaatgcgtagatttttattacctgttattttcgtgattgcggcagtggtttattctagtatcgtcgttgtaacggaaggtacccgtggcattatgttacgatttaacaaagtacagcgtgatgctgataacaaagtggttgtatatgaaccaggcttgcattttaaagtgcctttaattgatagcatcaaagttttagatgcgcgtattcgtactttagatggctctgcaacacgttttgttactgttgagaaaaaagatttgctagtggattcttatgtgaaatggaaaatcagtgattttggtcgattctacacatctactggcggtggcgattatgctcaagctgcaaatttattaagtcgtaaagtaaacgaccgtttacgttctgaaattggttcacgcacgattaaagatattgtttctggtacacgtggagaattaatggaaggggcaaaaaaagctttaagttcaggacaagacagtacggcagaattaggtattgaagtgatcgatgtgcgtgtaaaacaaattaatttaccagatgaagtctcttcttcgatttaccaacgtatgcgtgcagaacgtgatgcagtggcgcgtgaacatcgttctcaagggaaagaaaaagcagcatttattcaagctgatgtagatcgcaaagtgacgttaattcttgctaatgcaaataaaactgcacaagaattacgaggttcaggcgatgcagctgcagcaaaattatattcagatgcttttgctcaagaaccacaattctttacttttgtgcgtagcttaaaagcctatgaagcgagttttgcaaattctgacaatataatgattttaaaaccagatagtgatttcttccgctttatgcaggcaccgaaaaaatagagtttaatttgataaaaacaccttcctcgtgaaggtgttttttatagccaacgtcttactttttgtttgtaacgacgatattcatcgccaaatttattttccaaataggcttcttctcgggctatttgacagtggttcataactagtataaagacaattacgcctaaccaagctaaactattacctaaccaaagcgtccaagcaagcaaaattaacagcaaacttaaatacattgggttacggctaaatcgaaatatgcctgtggaaactaattttgttgtgcctttaaagtcacgaggattaatggaggttttacatataaagaattgcataacgctgcttaaagcaatcaaaaatgaaagggaaataacaaaaacaatcactnaaaaaggacagggtaccgagtccgaattncgaaaaca

SEQ ID NO: 275 - DNA, 1894 bp, H. influenzae
tgtttacgattcggactcggtaccccccttaaaagccaaccagacatatctgacgcacctgcagacattgcagtaacaaaactgcctaaacgacgtccaccgagaatgtaatctgataaattattcgtgtaataataggcgagtacgccaatcagcaacatcccgaaaatataaatagtaaaagtaataagacttgggtcgaatccaaacattatataagtccaaaatgggttaaaaatttcagaaagggtgcattttaccttatttcgggctattattctatttagactaaatatttgatgaaatttaagaaattaggaatataaaatggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccacccattgatattaatacaggcgcatttgtggggcatcgtaatctataagaaaccatctttcaataccaatattgaagcaactaagccatttgcgcagcactccaactacgtaatcttggtgggcataatcattattgattttattgatatgcaaacagatgaacatcgcaatcgagtattgcaatctttatgtgatgcgctttctaaagatcgtatgaaaactaatgtgaatggctttacgcaattaaggcttgtagaaatgactccgaaaagaacccgcgaaagccttgaacacgtgctatgcgatgaatggccaacttggcatggaccgggtcgcggtgaaaacctgtgagacaggttggtaccaaattatgcgtggaattattccggggggatcatttatttcaggagtggcactttggtggttatgcctgcgcagccgtttcacaaaattttattaatgaaaaattctcccggttactgccccaaagggaatgggtttttgggaaagcggttaaggtaaaacggacccgtttttatcccaaacaacttgtggggggggttatgggaaccccttttccaaaagggggggaaaaatttttggaacttttcccgcctttttttttttaaaaccaattttcttttattttatcaataagg

SEQ ID NO: 276 - DNA, 1428 bp, H. influenzae
ataatcggtgatggatgatattgtttaaattgtgcaccgatattttcaattttatctttgagttcgtttaaattaaggacgcgagcttgacgttcgcccacggtttctgtgaaaagtgcggtcggattttgagataattctacaccttgaattgaaaacgtttttaaatcaacctttttatcacgacccgcaatttgctgcagacgcacaccgacaagaatacgttgatgacgtgagttaatggtatctaataccgcgtaacaaacacctggacgcaatttaccatgtaaacctttatcgcgagaaccgcctgtggagccagcctctgttgtattacggaaatgtaaaagggttaaatcgggaattaatgcggtcacaaatccagccattgtggttgatttacctgcaccgttaccaccagaaagcgtggtaactaattcatctaaatcgaaagtacgggcaaaaaaaccattccagttaattaaggttaaagaacggaatttaccacgctctacaccattatttgtcgtcatgctaaaaggcataggtgcgtcaacgatttcttcgacgttttcattttccataatgacttcatcgctctctaattcgatttcattttctaattcaaaaacatcagacattattcttgttctccgtcaaattcttcgtcaatttcatccgcactttctgtatcgttttccactaattgtgcttgtttttccaacgataaggattcaggtgttgccgcttccccatcacgaatgagtctagcttgggcctctaatggatcatctccgctacgcacttccgccccaaaacgaaatacagattcagaaatagtaaatttcccactattttgttcgccaacggtttgaatcatacctaaacgacgtaaacgaccaattgcagctcgcactttttctgccaatttttgtttatctaagtcagaaccacttgaacgctgattaactgcttttaataattttccttcatcagcaagatttaataattcatcatacacttcttgcgtgctaaaaataccttgttgggctaaacgttctgggcttaaataaagataacaaagcactttaccaacaagcatttccaactcagccagtactgaacgtgcaattaatggtcggtgctctccggcgaagatagaagaatccttctggcgccacgaataggtccacggatagcgacgatgaaagccgcctatttctttgggaaacgcattagacaggcgagatattctaaggcccgggcctgtctggcgccccgtgcccctcttatttcttctcgctgcaaatttggtattggcattgcacacgaccgtgtcgggaagtaacccttgtagctgctcgcctctcgtctccctcgatctcatggccgccgcgtagtcctccgcgaccggccccgctcccccat

SEQ ID NO: 277 - DNA, 1821 bp, H. influenzae
tgttttcgaattcggactcggtaccctcattgctcattggctgagcagtcataattcctgtcgttgcccaacgattaaccgtttttccatttgaatctttttcaacaaagttggcatctcggtcatctttcattaaacgagcaatacgtttaatggcatctttccaagaaattcgttcccatttatcagaacctggcgcacgatattgaggatataaagaacggctttcactattgacataatcgagtgagccagcacctttcgggcaaagcgcaccacgactgactggatgatctggatcaccctcaatatgaaagagttttgaacgagtatttgtgccagtatggctgcttaatgaattgtaaggtttgcctgtgctatataacaacataccgcaacttacagcgcaatatgtacaggtgttacgggattcaaacgcgcgtaataatttatattcgcgtggcgcagctaatacgtttgctggagcaaagcccaacattgcagctgacgttcccgccatacctcctgcacagatcttgaagaattttcttcttgagacctgcataatcactcctttcaacaacaagttgttgagatattatagatagtaataaaattcgtttagtagctagattatgttgatttcgttaaaataacactctctagtatataaatcatcgtaaaaacgttgatttattggatggctagagtaacgattttttaacgataaatccataatcaaatgacattagcttcaacaaatattgtgatctagatcataaatataaaaataatttaacagactttttacatttaactaatggactggtaataaatgcagtgctggattcgacaaactatcaacttttttagaaagacaaaaaatacagaaaaattgaccgcacttttgcaacaaaaagaggacatactggctgttgagatgccagtttctttagtatataacgggatttctcacgcagttatgatgtgttccccaaacaatttagaggattttgctttaggcttttctataacagagggaattattgataaaccagaagatatttatggcattgatgttgtagaagtttgcaatggtattgaagtgcaaattgaactttccagccgtaaatttatggcattaaaagagcatcgtcgtaatcttacggggcgtacaggctgtggtatttgtggtacagaacaattgaatcaagtatataaaacttttccaaaattagactgtacttttcaatttgatttaaatttgctagatagttgtcttattgatcttcaaaaaaatcaattacttggatgtaaaactggtgctacccatgcttgtgcatttttcgatttatatggaaatatgttagctatttacgaagatgtaggtcgccacgttgcgttagataaattgcttggttggcacgcaaaatcgggtaagcctagaggttttattttagcctccagtcgagcgagttatgaaatggtgcaaaaaacagtggctgcggggtggaatgttagtcacgatttccgccgcaacggatttagcagtaacaatggcagagaaacataatttgactttaattggttttgctagggaaggaaaagggaatatttatagtggggcatcaacgacttcacaattaaccccaactaagagcgagagtttttgaggggtttggggtgattaaggaaaatagcgggatttggctcctttggatgttaaaaatagaggaatttagcgggaaacataaattatgtaatctaatttaggggattggggggggtttaatatgggataatccccctcatttttaccaa

SEQ ID NO: 278 - DNA, 2237 bp, H. influenzae
  misc_feature (1245)..(1247): n = a, c, g, or t
  misc_feature (1249)..(1254): n = a, c, g, or t
  misc_feature (1256)..(1257): n = a, c, g, or t
  misc_feature (1265)..(1265): n = a, c, g, or t
  misc_feature (1269)..(1269): n = a, c, g, or t
  misc_feature (1272)..(1272): n = a, c, g, or t
  misc_feature (1278)..(1278): n = a, c, g, or t
  misc_feature (1282)..(1282): n = a, c, g, or t
  misc_feature (1286)..(1286): n = a, c, g, or t
  misc_feature (1293)..(1293): n = a, c, g, or t
gccctaatgcggccgtttgggtgtaacaaaaggcgggtggattttgaataattgggcgggggttttctttacgcggcggaataaaaaattccattaaaacttggcgtaatcaaaaaaatgtcctttttgcgcaatggctcatatcaatgttgtattttttcgcaaaagctttaattacaaaatgtgttttttgccccatttttgtttagcaacccagccagcaatttgagttaaataaatttgtggcatgacatattgaaatgccactttttaagcgttgccaataagaatttgaagtcatcattatctttccttgttaaaaaaagaggcgtgattatagcaatttttgttatagttccaacctttttagttagcggataatttcctttattgagttatccaataaaaaatgtgatttccctttgactatcttcgcaacaacaggtaatattcacgccctatgcaaaaggtaaaactacccctaaccgttgatccagtaaaagatgctcaaagacggcttgattatgttggttattattcggcaaatcagcttgagcgtttggcggaatcagtggtaaacgtgctcagcgatgcacaggtaacattatcgttttatgttgatccacaaaaattagtggtgatgaaaggtaaagtacagattgatgtcgatcttgaatgtcagcgttgtaacgaaccttacaaacaaacattggaatgtgagtttacttatagtccagtggctaattgggatcaggctgatgacttgcccgaaatttatgagccaatcgagttcaatgagtttggcgaaatagatttaattggcacggtggaagatgagctaattttagctttgccgcttgtcccaatgcattcatctgaacactgtgaagtgtccgcgcaggaacaggtttttggcgaattgcctgaagaattggcaaaaaaaccgaacccgttcgctgtattagctaatttaaagcaaaagtaaattaaatttaggagtatagccaatggctgttcaacaaaacaaaaaatctcgttcacgtcgtgatatgcgtcgttcacacgatgctttaacaactgctgctgtatcagtagataaagcaagcggtgaaactcacttacgccaccacgtaactgcagacggttattatcgtggtcgtaaagtgatcaataagtaattttttacttataggtgttcacttgaaccgtctaaccttggtgttagatgtatgggcgggggacccnnngnnnnnngnnttactatntggnttncattancatngganaataatncggggtggtcttatctcttacttggcgatagtccatagattttttcctttttaatcgcttatcttattgagtatgaatagtagaattttatccaccggtagctatctgccgagccatattcgcacaaatgcggatttagaaaaaatggttgatacatcagatgaatggattgtcactcgttctggtatccgtgaacgtcgtatcgcagcggaagatgaaactgttgcaacaatgggatttgaagcggcaaaaaatgcgatcgaagctgctcaaattaatcctcaagatattgaactgattattgttgcaactacaagtcactcacatgcttatccaagtgcggcttgccaagtgcaaggtttattaaatattgatgatgcgatttcttttgatttggcggcagcttgcacaggctttgtctatgctttgagcgtagctgatcaatttattcgtgcaggcaaagtgaaaaaagccttagtgataggctcggatctcatttctcgtaaattagatgaaacagatcgcagcactgttgggctatttggtgatggtgcgggtgctgttattttacaaccgagtgaacataatgaattatctcactcattttacccctttaacagaaaaaaaatgtccttgtttagctcgccaaatctggtatacaaaatctgctttattaaatccaggtcacaatacgtaaattggccgttcctgactttcaatgggtggaaaaacccttttacctaattttataaaaaaaatttaatgctttgccccccaccatttttctttttcccctccctcttaaatttaattgacatttcactggtggtacctttaatatccctatatttctccctcggttttgtgttgagaatgctcttgctggtctgttctcgggcctgccttttttctacctctcgtgccgtgtcttgggttctcgcttg

SEQ ID NO: 279 - DNA, 2592 bp, H. influenzae
ggatatcggctcggtaccccttcacggctggtgtatggtttattggttcgattctcgctttaatttatacttggttttgtatgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactgggtaagttttaaaaaataaatttaaattattaaatagcgatctgcactttaactgtgggttatgtagtccaactaattcgtgcagatcagcccctcaattattttactttttattagttacaaacaattttaactgcaagtccgccttgagatgtttcgcgatacttggcgttcatatctttacctgtttcgtacattgtttcaatcactttatctaagcttactcttggattggtggtgcggcgtaaagccatacgcgatgcattgatcgctttaactgaagcaattgcattgcgttcgatacaaggtacttgaacttgaccgccgacagggtcgcaagttaatcctaaattatgctccattgcaatttcagctgcgatgcatacttgtagtggattgccacccaaaatttcagctagtcccgcagcagccattgaacaggctacacccacttcgccttgacaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccgttagttggtgccgtaaccacgcgcccgcccgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaataccgtgttcaatacaagcctgcatcgttttccagacattctctagatgagcactaacagcctctttgccattcaatgcgatttcattttccaacatcacagtggaaagcattaagccgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttcactttctcgatgaaacctgaaatcatatcgatgtccacattatgtggtaaataacccgctaatcccataatgatggcgatatctgtactgtgacctctccctgtcatcgaaagagagccatacacatccacataatttcagctgtttgttcaaactgattcgggggtctctagagcgaccgcaggcagcaagtctggc

SEQ ID NO: 280 - DNA, 2039 bp, H. influenzae
  misc_feature (1734)..(1734): n = a, c, g, or t
  misc_feature (1737)..(1737): n = a, c, g, or t
  misc_feature (1751)..(1751): n = a, c, g, or t
  misc_feature (1788)..(1788): n = a, c, g, or t
attcggctcggtaccccattagcgttatttgcaaaagcaaaaatttcacgttgttgatctagtaatgttttagaccttgtaatgtgcctgataaacattcttgtgcctcacttactgcaatatcttctttaattcgagatatttttaagtattggctgtaagcattatttggtgtgtaacctaaagttaaaatacgttcagccacctcatctactctagcaactaaattagtataaatttcttcaaattttgcgtgtaatgcaaagaagtttacgcctttaatgttccagtggtagccccgcacattagtatagaaaacttggtaggttgcaagtaattcgttaagtttatcggctaattctgctgattgaactttatctagtccgattgatgtttttgacataataatttcctttttctagttgaataattgagctaatgccctccctttgatatgggtattatacctttctataatttgaagtgaaattgttctattcaatataattgatagccttagtcttatttgttaagaaattgtaataaatagaagctatcaaataagtgatcaagatcacaattttaatgaatatttaatcaaactatcgcagctaacaataaattttgatttaataagtacagttataatttttaatattttttctaaggatatgttatgcaagaacttattaagcgcaccttgccacaagatgatgcacttaatcaagctattgtgaatgaacttcgttcacaaaattgggctggttttttaaattattcccaagtgcagcagctttgtcataattttgaacttaccccactaaaattggctatgcacttgttgccacttgctgcaagttatagtcatactgctatttctcattttaatgtgggggcaattgctattggcgaacaaggggatttttatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatgaattgcacggtgctgaaaaaatttcaattcatttgccgcatagccaaaataatccattacattcttatttaccggatgcgtttgggccaaaagatctcgatattgcagcgcatcttttggcggaagaaaatcatgatttagttgctgatcatcaagatgatttggttaatcaagctattttagcggcaaatcaatctcattgtccttattcaaatagtccgcacggcattgcgattttatttaaaaatggtgatgtggtgacaggacgttatgcagaaaacgccgcatttaatccgagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcagtagaattagagtattattctttgtaaatatgaaacgcgagtaaaataaaaaggaaataatttccttttttatttatttgctaaaattaccgctcttttcggtgcttgatagccttcaatggttttactgtgatcatttgaatctaaaaaatcaatcaggctttcattttccacccatcagttttacgctgttcttctaatgtagntgncgctacatccacancacgtacgttgggtaaagccaactttttctagccagntaattagtgcggcgacagaggggataaattaacatttttcattttcgcatagcgatctgctgggatgagcccagtatttacatcgccatccaccacttatggttctataccaattcccaccttttacaattgattttcattggctaaagatctatggggattacgatgatgagacgcccatgaaatcacggccaatgccctaatgttgctttgctcataccaggggaaagattgtccgcatcatttagcct

SEQ ID NO: 281 - DNA, 1765 bp, H. influenzae
  misc_feature (1726)..(1726): n = a, c, g, or t
  misc_feature (1730)..(1730): n = a, c, g, or t
  misc_feature (1740)..(1740): n = a, c, g, or t
  misc_feature (1752)..(1752): n = a, c, g, or t
  misc_feature (1757)..(1757): n = a, c, g, or t
gagaccccatgtgataattagaaattggttaatcgcagccgcaacttcttgatcttgataaatattgttcacaatatcattaaaagtttgagatagcactttatgaatttcatcattgtccgcattaaatacgccctcttgtgaacgcgtgacattaaatgatttattatacgaacctttcgcaccttgtacataaactgtcgcttgaattttagtattaagtttataacgaagattaccttgttctacttgcgtaccaaattcatgcacatctacagttacccacgcatttgaaccatttaattgcccaattctaaagcctttactaattaaattttgctgcatcacttgctgaaataattgtgtaacacttggggatgcatttaatttaatcagttccccgtgtttcgtataactcgcaatctcttgtattgtgcggctatcttttgttgtaacagatacaacggcagttcgattaacattcattgaagcacttggcacaggcggtgtaaatgctaatatatttgattgtgcttggcagcctgcaagaaataatgtagcagctagaatacctactgatgataatgttttaattttgtttactaatgccataatttccccataaatcaattagaattgtgctattcttacaaacttccttattaatgtatagcgtttcattttagtttttgtggagaacttatagtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaactaagaattaaatcatagtattcacgcattagcattacatttattcactccagaagaatggaaagcacaaaatgaaactgtaccgcactcaacaaaatgtgcaggtattgggcgttaattttgttataaaaatgtaacatttttgatatatcgcaaaaagttctaacaaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttnccanccattgggtnaccgaggcccgnaattncggataac

SEQ ID NO: 282 - DNA, 2105 bp, H. influenzae
gagaccccctgtcccctttgaaaggcattatcatctaaatagttaatagtatcggctagctctttggcatctttggtggttaatttaaagtttttctgtactttaccaaataactctactaattcatcggggttttctgcatcaaatgctgttgccatttgggtatttaagcgaataaaatcttctaattcattttcctgaatatccattctcgctgcagcagtaaccatgtcaccaatttgatttgtggtaagaggtaattcagttgaaagctatttaatcttgtttttccattcatcgtatttaggggtaaattgcccaaatttgtcttttagccctggaacttggcgagcaacccccgccataacatcttcaaacgacataaaatctcgaatggaattgacaattggtgcagtcattgttgtacctgcagctgttgcctgtgcaccaatgatttgtgctttaccactgatatctttaagtttctcaacttgcccacggtattgattataagcggcttgttttgcgttgagttttttcaatgcggcttcttgatttttaatttgatccgttcgcacttttggtgtttttctgtagttccctttgcttttgcgcgagtttttctgcagaaatgcctgattttgctaattcttggcgtgcttgctgtaatttatttgctgcatcaatttgttcttgcttgagtttttttaccgcactttttgctttctctacttccttttgaaatcctgcagtaggatgttgagcgttcttcatatattgagcataagatgcggctttttgttttgcttgctctaattcttgattcagcgaatctaattttgatttcaatgggttgatagcagaagcatattgtttcattgcagcttgatgctgcttattttgctgatttagttgtcgatgaatcgatttgctttcttttagttttgccgatagctcatgaacgcttttagatgcactgcgaactggagcagatattttatcaatggcatttaataagactgtaagctctaaatttttcatttttacccactttttcttgacattttaggaataaggaacaaataatgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattgtaaattaacccaattaaaattctttacccgctatagctctaagcacaaatctttcaatcatttcaatatcttcttccgcaaagcccagtaattcacgctgggcatattgcactttgaaatctttattgttagatggtcgtgccgttaaaccgtattgatgcactgcgaactggagcagacattttatcaagggcatttaataagacggtaagttgtaaattattcattttttcgccttatttttattgacaaataaacgtatgattgctaataatgaagaaagagaataaggagcggatatgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccacttcttattaaagtaatagctttgctaatgggtaccgagtccgaattcgaaaaca

SEQ ID NO: 283 - DNA, 1983 bp, H. influenzae
atccccatcaacgaatactatgagtggatgggcgaaataaaatcacccgaaatatcaaagaaatagagcaactttatcccttaatagagaaaatagaaaaatctggaaaaagtcttgaaatttcctatgcaaaatatatttctcttcaattaattaaaaaaataattcgcatcctcaataaaaaaagagcgagtaataaatgggatgaatatgatgtaaattcatttattttatctctaatcaaactaagaatgacaatcaaggaattatatttaattgaagttaagggtgaattaagaacagaagaagaactcaatgctattgctgcagatatatccaaagcaaaattgaatttagaagagcacatctcacttgaagagcaattagtagagaataaaaaggagttcgaaaatttaaaaaactcactgattacactcaaaaaatcttataacgacgcacaagaacaaataactgaaatttcccagtggcacgaacagtcagagaaattaagtggcgacatttcgaactatgaattcaccgcacaaaataatcttactaaaattacgacattagcaaccacagcggaaaccaataaaccccaaatcgaaaaatatcatgaagatattgaaggtatgattaaattattcaataaacaaaaagaggagattgaaatgattattgaagacgccaaccgagcaagcatggcaggttcgtttaaaactcaatctgaaaatatcgatagtaaaatgaaagctgtagataaaattttgctttgggtcacttgttgcaacatctgttatttcattggtcaattattcaacaagcctgagtgcagcagacagccttaatattttacaatttcttgctaagtccattgtgacaatcccgttacttgtcatcgcctggttaaaagcaaaagaacgggcttatctctttagattaagggaggattataactacaaatattcctcagcaatggcatttgaaggttataagaaacaagtacaagaacaagaccctaaattacatcagcaacttctgcaaattgccgtggataatttggggataaatccaaccaaagtctttgacaaagatttaaaaagcacaccacttgaaacaattatcgatggagtaggaaaacgcctggataaagctgttgatggtattaaaggagaggtgaatgacattccaaagaaaacaaaagaattaattgatgatgaataactcgctccctcaaattctcagcgctttttatttgacaccgccctcacttcggattaagataaccacactttcaacagaaagtcgggaatgtcgcagtttctgaataacttggagcggtggaaagacagacgctcaatgcgtctttttttatcgccacaaaacagctattctacctttttcataaatttatgaaaaagcccaatgatgaactgtttaggaggatcgaaagatccgccgttttgctctaagtacggtactgcgaatcctattcagttcatcaccaactattcgcagtggttcgtgatgagttttaaaacttaacttagagcacatcacaatgacacacttaaacttaattcctgtttttaatggcttaatccaaaatcaacccgctcaactttgcaacgctcgcgaacttcacgcattcccacaaagcaaacagcacttcactgatcggatcaaaaaccgccatcaacgaacatggcttcattcaagatgaatactaccctgtcatccccggaaccccctcaatgcatcccctttctgtgttcccccccttatccccatatatcggcgcaaaacctagaatttccttccctcccctaacccccccatcccatttcattccccccactccccttccccccctcgcctccttatctcctttctcacccccccctttgcctcccgcttttttgtcccccccccctccccttcctcccctccccctttttcctttttctcccccccctccctccc

SEQ ID NO: 284 - DNA, 2481 bp, H. influenzae
gatttaagtaggattaattggttaatcacacgttttatgtttattaggcaaagttaaaaaaccttgcgggaaagtaagcgattttcaccattttgaaatcaaattcaatgaatttttgtttgaaaagagtgctgtattggttcataaaaaatatacactttagttggttatttagtcaatttttggggtgtagatcataaaatgcgttttttaatactaacttttttaggttaatcaagcgtcttcctattttaataaggaattatcgagtgacaaatcttcatttttatttacacctataccgcgtgcgataacatttttggcaatttcgtgtgcatcttctaaggaatgttccgtatagcttccgcattgatagatatttaattcgggaatagaagcttgatcttgtacacctaaaacatcttgcattgaagctaaccaagcctcagacacttcctgttcatttggtgtgccaatcaaagacatataaaatcccgtgcgacatcccatcggagaaatatcaataatttctatgctatcgccatttaaatgatcgcgcataaatccagcaaataaatgttcaagtgtatgaatgccttttggggaaagaatttctttgtttggaatacaaaaacgtaaatcaaaaacagtaatattatcgccttttggcgtgcacatcgtttttgcaatgcgtactgcaggtgcgttcatttttgtgtgatccactttaaaactatcaagtaatggcataaattttccttataaatcagttggttaagaaataattgaataaatatttattttttacaaattttaatgaactttatagtaaggttcattgtcttatagaacaagcaacttgcagttgttttaataaaattggttccttaggttatttgccccacatttattgtggggttttttcttgctcattttataataagaatggtgtactcaaaaacaataacgcaacataacgaaccatttttcccagaaagataaagagactactcgttacaaaatttaatcttaaccaaccagctatggcacaaaataaatcgccaactacaggcagccagctcaaaagtaaaacaatcgccccataacgccgtagctgatttattgcccataaagtgcggtaatttttgggatcgaattttggcatccatcgtccaattccgtaagtggttaaacttcctaagctatttccagcggttgcaatcaatattagagctaatatatctgcgttaaataaagaacctaacattaatttaggtacagcaagcgcaacaaatataacttctgaattacctggtaatactgttgcactcaaaaacgcgctgataaacataaagcataagctattagcctgccaaaaatcagcactaaaaaatgaaaaaatatccattatcttggcgaaataatttctcgtgtgcgaacatcaaacacatccattcccgcacttaatcctgcttgcacgcctaaatccgcatcttcaaatacgatacaacgacttggatttgcttgaattaactccgcacagcgtaaaaaagtttctggatgtggtttatgttcttttacatcatctgcactgacaatggcattaaagtaaggtgcgatagccagtttatccatcaacatatcaataattttacggtgtgagccagaacctaaagcaatcggctttttctgatggaaggatttaacaatttcaaaggttggcaataactttgattgggtcggaataagttgataagacaactcacgttttgcagccagcacatcctcaattcgatctagtggcatattcgccgctttcatcatttcccccgcgatagttcgaaccgtcgccccgccgaagttatacataatttgaaaatcaaattcatagccaaatttctttcccaccattgtccaagcctgcgcatgcacgggcattgtatcaattaaagttccatccatatcaaaaatcaatccttcatatggattgaagatctcgtaatctaacatttttacatccttacaaatttttttaccattttgctacaaaactgggatctatgcactgttttatttcagttaaagtgcggtaaattagcgaacaaattttgaactaacttaaaccaatgcggttattttaagcatttatcaacgctgggaaaacttccaggcaaataaatcaatctttttttggtggggggatttcctttacgagatccctttatcttatttttgggctagctgtatgggattactctttcaaggggttcctcacgcccctacttattggtttggtattttatgcccgcctattaacgtatatggttggttttttttcctccgtcttctttgtggcctcattaaaatttcaaaggatgtttcttccccccctggttatttgttttggcccccgcctcggctgttattgttggtattttatccgcccggtgttttattcttttttttgctctctatcacccg

SEQ ID NO: 285 - DNA, 1626 bp, H. influenzae
  misc_feature (1563)..(1563): n = a, c, g, or t
ctcaagttcaagataattacggtaatctaacaattcttcgccgattgtttgtgctgtgcgttgtcccatatcaatatgtggattgatacgttgatagagcttcgccatagcttcagaaaaggtgatgcagttgtcgttaaataagtcttgatattcatcttgctgaccagaaagtgcgtccaacaacatggcatgggtatcacgaatattcactaccaaacgaacagattttacttgaccaaacgagatgttttgcaaaccttgattgagcatacgaatacgattttgttcacgctgaatcgttttacgcataatatttgcaacactttcagaactgatcgccaattttttctcacggccagttaattcagccgttaaacgagaaagctcaatttccatttgttcaatggcatcaattggatcatccgttttaatgatgtcttgacgaatacgttcacgtaaatgctgatacaccgcaataaagaaccgcactttattttcaggtttgcgactatcttccgacactcttaggctatcacgtagatattcattatctgccaccgctgtacgcaacgcacctaatgctttatccgacattgaacgtaactcatctgcagataaataagcgagctctcggcgattgaggcgtttttccatatcagaattacgtgatagacgtaaaactacacaccaactcactttcgctgctaccactaattcacgttgagtcttataatcgcgttcagttttgcggattagacgatttaagttgtccgcttcactttcaattaatgtgagttgtttttctacataagaacgacgctgacggctcgttgaaagttgttgatgtaattcatcacgacggatacgcgcgcgttcttcagcaccatcatcagctctcacgccaagatcgctaatttcactaatcaattcatttaaaagctgatatttactatcgtaagagctttgtaactgaatcaatacgcgattatattcagcaaattgactttgtttttgacgaacttgctcacgttgcatatctcgctgagcctgcatttgttctaaacgttggcgaagtttttcgttgagttcagaagttttagcctgccctgcatcttcataaccaaaatgatgtttacgttgtacaacatcagctaacgcaaatacacgttgttgaacttgtttttgacgctcaatcgcttgagttaattcattttttaagccgtcgtaattttctggatcactttgtaaactattggcaatcggctctaattgtgacaacgttacgccatattgacgaataaaatattcatcttgctctgcaatatctaattgttcacgacattcttcaatacgatcaattaaatcttcatcagccaatacattgagctgtggaaataacttgttgagtaactgcagtttttcttttgcattatttaattgaaagccgcaaccgcggtcccccgctattggattgatttaattcacgatacatttctttacgcgccgcgaggagcctcaaaccttacctttttcgtctcctgttggaagtccccgccgttncggttttccacacactgggcgagatgcgcggcgtaacgtttgtttcttttgtcccccaacgca

SEQ ID NO: 286 - DNA, 1704 bp, H. influenzae
  misc_feature (1676)..(1677): n = a, c, g, or t
aaagtttactgtaagaaaatgcggtcaattttcaccgcactttaaaggtaaggttgctcgtattctacgaggaacaaaaatgatgtgcaaataataaagaaataattaatggaaaatattgtaaaattaagctctacacgagcattacaatgatttctctgtgcgagcgacctttttaatgccgtcttcttttaagcctagttctgtagcaaggtaatcaaataccccaactttagaaatggttgcgggcacaactaaaaaaccatctttagtgatggttctttgtgtagctgcttgagtggttttgtctgtaaatttcatttatttaccccaataaaaaactcggcaatttcaggccgagttgaatttagtatcttaagagtgataaaataagccaagccaagccacaggcaatagggcatagcacgtttcggacgttaagcagacgccatttgtgagtcaagcactatgcggagcttgtggctttctttttccttttaatccacattgttttaactgcaatcttcttgtgtctcttcctaacttcctgcacgctgaatatttcgtcatcaatctcttttttaatcaaaaacgtttcattccctgaatcgcttgtcccagtgtactcaatgctatcaaatgcggagacaaccaaaggcaataataaaatgtctttttttgtaacggctctttgccctcgtttattttccgctttttcgtttccatgttgtttcaatatgtgtcggatgcttgattcatcaatactgtgttgccaatctgtaatatccaaaccaatactctctttcgctaacgtaattaattcagaattaaccccaccaaagttagaaaatgacttattaccacctccaccgatagagctttcaaataactcatcgagatccattttccctgtcttattaggttctgcggcctggtagcttaattcggtttcttctgattttaagttaactacatcatcaagcactggaatctgaacgcatcgacaattaacatcatgaccagggtgaccagtatcggcaggcggattggcatattcgaatatctgcccatctttttccgcatggctttctcgcacacgctcatcacccgatgttgaccacatgtatttttttataccaacctcttcatgtctcgcttgcgttaaggcggcatttaattttgaggactggtctcgagcaataaacatcgctcgtttttcggttgttttacctaagtcttttacttgtgctgcaaggtctttatttaaagaaccccgaaccattgcttgcatgacggtattttgcactttatcaagatattgcgagcgaatagacttgattaactggatattaccagcggtcaatgcattcactctttcagcaatatttggactattgcgtaaataagcggataaatcgatgccagtttggtttttcaaattggttgatacttcagcatggttttgtgcatcaccacgaccaacgaagccattggcgatattttcagcttgagaagtgcggtcagatttttcgtacttttctaatactttcatcagcgctttcgcactaatcgcctggaaccctttcgcatcatccataaaaaaagagccttgcggttgttgcatagctctttctacatcatcggtcatcgttttgacgaactgttaaggggtcccnntagagcgaaccgcaggcagcaagcagc

SEQ ID NO: 287 - DNA, 1930 bp, H. influenzae
taccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccattgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgttaaaaaagccatactgttatattgaacagtatggcttttttatttaaactttatgttatggaataatcaaaagattttttagcatattgctaaaaacgagaaaccccgtctcgtattccaaagagcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaatcttaaagaattctttccttgattgcaagggcaattattgactttgaacctttctccacaaatctttactgtaaatgacaccgacagaatttacttgagcacccattatactcggtgcaagataaacaggcgtactatattgaaaaatgggtaacactaaatgctcttgttgaactatcccttttaattttgcgtaattttctaaccgcacttttccggatgtcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggccgtttgcaattcttgccagctcatcccttgattttcaactcgtaataaatcagattgtgataattgatgatttaatcgcattgcaatggtttgattcagagatgaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgatcgacttttttcggattcattacaacatcaaaatcagacaaatctgcatctgctgcaattttttgatacttcacttgctgaaatatcactttttctttcgcccaataataaggattggtagttaaaatatgctgattttcagcctgactttgtaactgatatgcgccattactgataaatatttcagtcgatttagcatagtgaggcaaaagactgacatgtgccagcatagaaggtaaatatggcgatgctttatctaattcgatgcgtaaagtgcggtcattttcagcaaacaatcctagggattcaacaggtcacgctctttccaatactgccttccgcatttttaagattcataaaaggccggttatttctaatgtgggctttccgaacgagaaagtgttcgccaagattggacaaaatttgaggcagcgttaggcttgtcattgtgacctttatccgttttacgcaatgggaaactccacgtgttattgggcttccggtccgcaatttcttggctacagttgggacgatgattactttcgccgaaccaggctgtttatct

SEQ ID NO: 288 - DNA, 2240 bp, H. influenzae
  misc_feature (2210)..(2210): n = a, c, g, or t
  misc_feature (2231)..(2231): n = a, c, g, or t
gtgcaaaaacaggcgttacttcctcctgcaacaatggaattgtaagaaggaaatcttgcgcaatggcgattaaattcatgcaaaatatcgctttcaatttcatattcaaagcgatttgggcgtgttgtttgcatcgctttaatatgcccaagtgccgtaatttgtcccgcttgttgtattaagcggatttcattcggcgattttataaggcgcatttcgctgagcattggtcgccaatctaaaatctcgctaaaattcaccgcactttctgacaccaatgtatcaccccaagtatgaatttctggcacatggtaaagtgcggtcaaatttttcagtatttttggcagtacggtagcgaattcttcaatagaataggcttcatttacattaagttgctgtggtgcacgctcaacacctaatcggcgaccattccacgtttcaagtaacggatcgcatggacgaagaaaaataatggctttttctacttgttctgttttcagtaataacagtgctgcattcggttcattaaagcctgttaaataccaaaaatagctatcttgacggaaaggataggtacaatcattattacggcgtttttcgatttcagaaaaaagcaataatgctgaattaggttgcatttgagcgaatactcgtgtgcgacgttcctcaaattcttctttaggcaatttagccatataagtcaattccatcctagatctccttaatgtaatacaggtttgctctcaatttctccttcgttgaaatgagaatagaataacattgcaatggtgcgaacatattcaatgatttcttctagtgcttccgcaagctcttcttcattatcatcttcattataaccaagttggcaaatatcttgtaaatcatctaccgcttcgccaatttcacctttttcttttgctaattcaggttgtgctaagccaagaccaagtaagaattggtttgcccagtcagataggctatccgcttgtgcaaagacattttcatcttcggttaaaccaagtccaaaggtaaatccttcaacatctgataaggtttgactaattttttcataaagttctgtaacgggttgaactaatgctgttgggtaagcgtgattatcattgctgaattgatataagagcggcagccaactttgatcttttaatccaccacaaagtaaaccgcttaaaaagccgtgtagttctgttgcattaaagccgattccagcagatttaagttgttggttaaggtcacaatgagaaatgagcataatagatttcctgagtaaatgtcaagctagcgtaaacctttggacataataaagccatcgcttgaccaattaaatagattaagaggctgggggggcgtcactgcttttaacgctagaaatgaacctaatttaagatctggtaatgacattttatataaaaaaatggtttattaaatttaacctctgtccattgataatattgctcgcttgctttttgaattccgccgtaatttgccattcaggatgatttaggcgtatctggtaaccattgggtttctagtgctatgccagaaaaatcggcatataattcgccatttctcgttggtgtacctgcaagataattacccgtataaacctgcaatgcagcttgcgaggttcttacttccaaacttaaatcgccagttggagaggttagtaacacacaaggcttttgccaagctttattgacaataaaggaatgatcgtaaccttttgttgcttgctgatccccttgtaaaaaatcttgcttgatgggtttagcaatacggaagtcaaaacttgtattcaccacgtgctttaatggagaattaggaatcccctcattatctacaggcagataaaaatcagcatttaaacgtaatgtatgttcacgcacgtcactgccttgcgctgcattttctaaattgaaataagcatgattcgttaggttcaatgcagtatccttatcacaaatccctgcatattcaatttttacgctattatcatctgttagcgtataggttacagacacatccacattaccaggaaaaccttgatcaccatgctctgactgtaatgaaaaacacacaaaattctcaccgcactcttgaattttccaacgacgtttatcaaaaccctctccaccatgaagctggtgctttcacttgattactacttaatttaataaggtcgccatcaattncaggataccgaggctgatatncgaaaacag

SEQ ID NO: 289 - DNA, 1425 bp, H. influenzae
  misc_feature (1396)..(1396): n = a, c, g, or t
gtatatcggctcggtaccccttactcttgcttgataaaaaatttcagcaatctgtataggcttgtataaatgtactcttgctttctttataattttatctaaagattcttttgctacttgaatatcgttcatttttagtccaataatgaaagttgaattgcttgatttattttaggcgttgccatatttaaactattaatcattgaaccagcaatagccctaattacaggaatactaactgaattgccagcaactttacgtacctgagaataaggtatattaatttcaaaagtatctggaaatccttgtaatcttagcatttctcgcccagttaatcgacgtaccccatttacaactagataattataacttcccccagctcttaatgcacaagagtatggaagagcagaaacatttcctgaaatattttcatgccaaattgaaggataaggcacatctttagtaattgaacttaatcttttccgttttagttcatctgaaagaaaataattattaggaacaacatcatcactctctaatatattagaaagttcttcatactttcctataggctttggaaattcaaaatgcaatttatctaaaaaacccacaatgtaaattcgctctcttttttgtggtaatccaaaatcaagggtatttaatactttatgatataccgtatatcctaacttatttaatttatcgttaataactttaaatgtattaccattatcatgtgttgttaatctttttacattttccagcaaaaaagcttttggttttttagctttcaaaattgcttctatattaaaaaataatgttcctctagtatcagcaaagcccaatcctttaccagcaatactaaatggttggcaaggaaatccagcaagtaaaatatcatgatctggtatatcgctaggagatatatcattaatatctccaaaaggtttttcgccaaaatttacttcatacatactttgagcatacttatcccattctgatgaaaatacgtttttacatccaaatgcttcaaaacctagacgaatgccaccaattccagcaaacaaatctattgttttatattctttcatacttattactaattaatacttatcaatcacatgcgcttgcacttcagcaccacgtttattaattgcttgccaatctggataaatacccgataaatcatcattcgccataccaaggcgtactgcttgatcaacaatgattcgagccacatcaaaatgacgagaaagtggataattttccagttgttcttttaacactaaactcaaatcaatcggacggttattttcacgataagcaatcagtaagccttgcatatgctctacaatttgatcgtgtaaatcagaaagggattcgtatgggggtctcntagagtcgaccgcaggcagcaagcatggc

SEQ ID NO: 290 - DNA, 2815 bp, H. influenzae
  misc_feature (372)..(372): n = a, c, g, or t
agttaggccaaaaccgaaaaaaagtttataccccccgggtcagccagtacccaaagcgaaaaccccccaaagctcatgcggtaaagcagggattaaaaatccccggtcggggggtcgattccgcctcaagggccacatttcctccttagttcagtcggtagaccggtggcctgttaatccatatgtcgcaggtcgagtcccgcaggaggagccaaatttagaaaggccgctaaagagatttagcggcttttggctttcttatatataaaatatataatcttctctagtctggtaactataactaggcatcaaaattcaaaatggtgtatcaatgagcgagagccttcttatttttgatgttagcaagcgacntaagtcgcttgcgtttaacttaaagaagaaaaatgaatcggcttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccacggaatacaccgcctaatcccgcaatgcgagttccttgaatatcaactatgcgattgtgtaaattgcgtgattgccacttagaaccccaaattgcattaaaagcactaatggttttgctatcatgatttccatgaataaaccaaatatcacaatgttgcgcaagtttatccaactcatctgctgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggagattcaatctctatataaggaactttatatttatctaacagttttttgagtagttgctgaaattgttggcgttgtttttgtgagcctaagctgcgcaagccatcatccacccattcagtattatttttaagtaaaatagggacatcgaaggatattctttaatcattgagtctaaaaaggatgagcttttccttcatattgaatgcagaacgcttgcgtggtaatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggttgcggacacattaaagaaagtgcggtcaggatcgactaacgatacttctaaacctaagtatttctcgtaaggcgctttatcttgaggctcgctactaaatacgattgaaggttcaaaatgtttttcatgaaatagggttttaactgcttcactccaagattgccagccgtttggataacttggaataccgtcttcaatcaaatgatgaataaaaatctgatttttttgatatttgaaaatttgctgcatccaacgcaaacgatcttgcacggttggcatgcgtttcattttactatcgtaaaataatttcaaatcgcgcaccgtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatggaaatatttttcacgttctgatttagtgcctaggtattttgcgttatacttagctcgcattctcagggcagggtgaaattccctaccgggggtaaagcccacgagcgtttaaaagtgcggtcaatttttgccaaatttttcctgcgaaattgtcctgattttcacttttaaagtcagcagatttggtgaaattccaaagccgacagtaaagtctggatgaaagagaatataacgagttcgggtcccaaaacgttcattttatctgcatttctccccctgattttgcctttaattgcaacccccattaccacctccctcttcaatccgcccgttctatctcttttcggaatcccggcttaaaatccgtactttatggcacaattcctttgaaaccccggaatggtgactccgcttttcatgtccgtacatccctctatcgaccctgattcaccctctttccttcatattcctggtgaatcccttgttcctttagtcgccttcgtcggccccgatccgttccttgttcccctgttatttttccccg

SEQ ID NO: 291 - DNA, 2125 bp, H. influenzae
aactgactatccgcgcacgtaatctattgcatcgcacaatgtcgcatcaagaaaagaaaatacatttggtcgagaattctatcgttttaatggttggaaattagacctaaatagccacagtttaattacaccagaaggacaagaattcaaacttcctcgcagtgaatttcgtgcaatgttacatttctgtgaaaatccaggaaaattgcaaacgcgcgaagaattgctgaaaaaaatgacgggacgagagttaaaacctcaggatcgtaccgtagatgtcacaattcgacgtatcagaaaacattttgaagatcatccaaatactccaaatatcattatgactatacatggagaaggctatcgcttttgcggagatattgaatgaagtgatttttctacataaaaattcctttttgaaattcatttcctgttttgttagaattcgcacacttttcaatatctaatggaaagtgagttcggatgaaggtagctggagagcggggaattgaccccacaccgacgatgtaaaatctttcaggtgcgatggcagggactgttactggacgaacccttggagagatccattttagaaatggacgccgaaggcgcaaaagagcggttaatttttcaatcgtttttcaaacgctcaggcaaaaggacaggggcaaaagacaatctattgtaagtgtggaaattattcatttttttaccgcactttcttttcacattgtatcttttcgtcttcttgtcgtgtttatttttgatttaaacgacgaggaatcacaatgacaattgagtcaattctttcagctattgatagctttatttggggcgcacctctacttatattattatctggtacaggactctatttaacgttacgcttaggctttattcaaattcgctacttaccgcgtgcgctaggttatttatttaaaaaagataaaggtggaaaaggagacgtttcctcttttgctgcactttgtactgcattagcagcaacaattggaacgggtaatattgtgggcgttgcaactgcggtacaagcaggtgggccaggggctattttttggatgtggctggttgctttgttaggaatggcaacaaaatatgctgaatgtttactcgctgttaaataccgtgttcgcgataaaaatggctttatggctggcggcccgatgtattacattgaacgcggactaggtatcaaatggctagcaaaattatttgcattatttggtgtgatggtggcctttttcgggatcggcacattcccacaggtcaatgcgattacccatgcaatgcaagatacttttaatattccagttttagttactgcaattattgtgacgcttttagtcggcttaattattcttggcggtgtaaaacgtattgcaaccgcatcatcggtaattgtgccgtttatggcgattttatacgtcacgacttcactggttattatccttttaaatatagaaaaagtaccagatgcgattttattaattattgatagtgcttttgatccgcaagcagcattaggcggtgccgtagggcttactgtgatgaaagcgattcaatcaggcgttgcgcgcggcattttctccaatgaatctggtttaggaagcgcaccaattgcagctgcagcggcacaaactcgtgaacctgtgcgacaaggcttaatttccatgacaggtacattcttagataccatcatcgtctgtacaatgacaggtattgtattggtattaacgggagcgtggaacaatcctgaattagcgggtgctaccgtcacaaactatgcctttgcacaaggcttaggcacatcaattggtgcaacgattgtaacagttggtttattattttttgcattcacgactatcttaggttggtgatactacggggaacgttgctatgcttatctcgtcggaactcctggcgtagaactatatcgtctagcttatattatgttgggctggtttacgggctttcttacacttaaatttaaattgcatttcccccgatattggaaatgagaggatggctttcccacatctatccgcctattggatggccaaagggacctttgaacaacataccttatctccaacgtcaaaatttatccatt

SEQ ID NO: 292 - DNA, 1853 bp, H. influenzae
  misc_feature (1845)..(1845): n = a, c, g, or t
cgggcctcgggtaccccaattacaaccgtattagcaaaaattacggtggtgcagcgcgtgcatttgaccaaattgataacgcaccagaagaaaaagcgcgtggtattaccatcaacacttcacacgttgaatacgatacaccgactcgccactacgcacacgtagactgtccgggacacgccgactatgttaaaaatatgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaataattgatgaactcttgaatgtcttaaagataaaagacagaagaagtaaaaagaaaagtgcggagaaaattctccgcatttttttattctatatctgatactttgcttgagtatttactaaattatttgatttttatagtgatagctgtggtaaataattttcagtgattccaacaagttcttctattgatattaattttatcttgctactttgaggtaaaagtgcggtgagatttcttgctaaaatatcttgttttaatatcatgcaattccctttacatttggcaaaataatcaggatattttattgccaataacacaccgtcttgccatagtactaccgcatctttttctgtaatatatgaaaaatagtcatctagttcagttttgggataatctgattgagaaaatgtataaagcataatattccttagaaagtaaacaatttttctgcttgattaagcttttctagcaataaagagcggtcaattttttcacaagataggataagttctctattatctaatttaaatttctgcaaagacgctgtgcagataaagcgttgttctacatcatataaatctaataatttaaaggctctaatgaaatctttttgttgaatgatttcgggttgttggttatcgataagatttaatacgccatcatcgataaaaaatatcccaatatcatgggttcacaaaaagctgtcgcggcaagaatggggtaccgagtccgaattncggaaaca

SEQ ID NO: 293 - DNA, 1450 bp, H. influenzae
aaccgctcaaagacaagccttgagagccgtggattatagaatatccttattttcaaatcaaacttttttctaggctttttgatttgaaaagattaaaatgtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaataatagaataataaacggctaaaaatatttctatttttagccgcactttttaattttcttctttattttcttctttattttctttaaataagcctgatgcaccatccgaataatctctaggctgttcattttgagatttatctgttgcagtaattaactgttgggtgaataaacctttgtgatctttttcgcccagtaaattattggaggaagttgcgtagtggcgataaagtttttgataatcgttaattaaggttttgaataactcagcactttctgcaaaatgtttttcgatttgcgccttttgtgtatcaagctgggttttgactgtttttaattcagcctctgttttagcttgatgttttaccgagcctttggttaaacgcacaataatgtaaccaataaataacccaacaataaaagcgataccaattgctacccaaatttcatttgtccaattttccataatattctcctgtttattcggcttaaaaactaacaagttgcaataataacaatttcaactttccaacgaggatccgctaatttagcttccactgtcgctcgacttggggggctaacatgatcgacccattcatcccagcttgatttaattgacataatcttgcatatctgccaagaaaattgcgcagtaaaaaattgcttttattggagcaatttctgctaacaattataa

SEQ ID NO: 294 - DNA, 1679 bp, H. influenzae
  misc_feature (246)..(246): n = a, c, g, or t
taagtaaggcccaaagattttaccccagcgattggcaatattaaatctaagtatatcagtaagaaattttccaggaaagaatcaatagggtcaataaataccctatggtgaaccccatatcttaacaaatcccctgaagtccagagagagaacgcatcgtataggaggatatcactatttcagatgcccacccctaatatgcaaatggctaaaaaaatgagcccgcttgtattgaagtttgctttntgcccggcttcaatagccaacaatgcagaagcaataaccgccaatccaaatccaaactgcgctgttctagagattttttcttttagaatccaataagacattaacgcagcgaaaacaggaaagagagatgaaagcggtgccgcataatagatcgttaaataatgaatgcttaataaataggcagacattcctattggcccacctaatacgccagataacgcaggttgccaaaaaacgccttgaaaatctaccgcactttttcgccataatgttatgccgataactaataacgagcaaaaatcaattaaaaaaagcaatgaaattattttccctaatgcatcatattcacttaatggcaattcattatataacaatccagataatgcccaaaatacagcggacagtatgccaaagagatagccacgcattatggcaattcctctaacagtttaaatgctgcgtctaagcgttttaatgcataatcgccaaaattctcgccgtgttcttcttttacttttgtccataaaaaccacaatacattttggcaaaagcgatggatttttaaccgtttgtgagcgatttgaaattctgtcttgtgatatttatttgtctgattgcaataggtttctaatagaaaatcagcagcttctttcgataaatgagcttcctcaatgatagtagctatatcaaatagcggatcatttaagcccgaatattcccaatcgataaaaaatagccgatcatcttgtaataacatattttcagggactaaatcattgtggcacggacgtaaaattatctctttattgatttcttcaaattgccaaaatacagctgaaagtttatccattctagaatcagcttgataaaaagcggatttgttttctagcaatgaaaaatattggcgaaactcatcgaatacgctaaatacattacggaaaacaaattcactattgtgtaaacgatataaattattcacaacttgagacaaacaactttgttcgtttaattgtatctggcttaaagtattactattttctaaataacgagtcagttttacgccacttttggcatctaatacgggagtttctacattcaagccagcacgatatgcctgagcattattgaatgcctcatattctcgatttataagtgataaatttacggcattagggatccgtaatacaaacttaactccagaaatattaagtagaacattttgattggtcattcctccaatggaggaaaaaggaatggaatgctgatgaagaaaatgaaatacttcttcaggcttgtagcaagttttaacaaatcctacaatttgattgattgattgattgattgattgattgattgattgaatgaatggatggatggaatgaatgcttaacatttttggataatttttatattaaaattggttggatttaacc

SEQ ID NO: 295 - DNA, 1488 bp, H. influenzae
  misc_feature (1212)..(1212): n = a, c, g, or t
  misc_feature (1225)..(1225): n = a, c, g, or t
  misc_feature (1412)..(1412): n = a, c, g, or t
  misc_feature (1415)..(1415): n = a, c, g, or t
  misc_feature (1438)..(1438): n = a, c, g, or t
  misc_feature (1457)..(1457): n = a, c, g, or t
taaggaaactccctgcattacccgtttcatttggatcaggtaatttactttgacggatatgacagacttcatcaaaaatttgtttagccgtgatagtttttggatcgaagtctacaagcgaaccatattttagaataggctgccaatcttttttaagctttaatccaaccgctgtaatcacgtaaccttgctgataacgatgtttaaaagtactttcacgataaccaaattcacattgttctgtgtcgagtctaaaggtttcattcgtgtttaaattaagtacatccacataatcgcacacatctttaaattcaacgccataagcaccgatattttgaataggcgcagatcctgcacagccaggaattaaagccagattttctaagccataaataccattattaatagaccattccaccaatttatgccaattttcgccgccattgacgtgaagatagtgaaaatttgcatcttgttcgtgcgtaatccccattaaacgatttaaaaccaccacgccattaaaatcatccagaaacagaacattactgccttgacctaaaaaaagtacgggtaaattttctgatttagaattcgcccacacttgttgtagctgttcgatactatgtgcttcaataatttcacgagcattagactgaatgtggaaagtgtgaaaaggttgtaaattttgcattttgatgtcctaatataatgtatgtggcaaggtaattttgacttgtgtgccgccttgttctcggcgatgaatatgcaattgtgcattaagctgacggcaacgttccgccataatattcaagccgtaatgcccttcaggctcctcaaggtttggaatgccaaccccatcatcttcaactaaaatttcatactcgccttccgcattaattcttgcgctaatttcaattaccgtgccttgagaatgtttgatcgcattggtggtggcttcacgtacaatttgcagaacgtgaaccagctgttgagggttcaaactttgcgatggtaattgacaattcacattcatttgcattgttgtttgtgagcgtaatgaatcaatcacttgttttagtgcaagctgtaaattcgcttcttgtatagttaaacggaaagtggctaaaagctcacgtaactgtgcataaccaccagaaagggcttgttcaaaattggcaataattgccaaactcttttcttttgattgttcgncttctttcttcangttatgtttgagcaaagtaagttgaatttgtaaaaatgattagacttgagcccaagaatcgtgcaactctcgcgcattattggagcggtccttcattataaaatctggtctttctgacgaaaatttttatggaaataagcgcacgacagcattgcgctaatttgctatttcggggatctggcactgnaanctgctgccagacataccctaatncttttatcaaaaaggtttngattggaattcttatacccctgctacccagg

SEQ ID NO: 296 - DNA, 2679 bp, H. influenzae
  misc_feature (2307)..(2307): n = a, c, g, or t
agggagagagggtcggcctaccaaaagagcgcaagtgagggagagggagaaatgatggaaccggtagagctgagaggacaattttataaagcgatcattgtacataccaatcgcgtcaatgagaccagcccggagatcctgagattgacgctgtgggtagacgatttgacttttgcccccgcacttttccagtaaagagaaagtgcaactatggtaaaaccgtctcggtttgctttgccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttattcagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgagaaagataaaaagatgaattaagtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaataccggcaaaagcccaaggagaaccaccacgttgaatatgccctaaaacggttgcgcgaggtttcgtgacctacgcgagcttcaattttctttgccagagaatgaacatcagttaaaagttcagtgatagcaataatagcgtggcgtttaccgcgaataatgctacgttcaatttgttgaattaattgttcgcgattaaattcaatttctgatgcgacgatatattcacaaccgccagcaatgcccgcagaaatcgttaagtcactacaatggcgacccataatttcaacgatagaaatacgttggtgtgagcttgatgtatcacgtaaacggtcgattgcatccactgcagtttgtaatgcggtttgatagccgatggtatagtcagtacctgcaacatcattatcaatagtaccgggtaagccaacacaagggaaaccgtgttcttcggttaataatttagctcccatataagaaccgtcaccaccgataaccacaagtgcatcaatgccgtgagaacgtaaaatttctgcacattttgcacgaacatttggatctttaaattcaggaaagcgtgcagaacctaaaaaagtaccgccacgattaattacatcagatacgctatagcgatttaattgtttgattttattattgtataaaccttggtaaccatcatagataccaaacacttctaagccttctgcaagtgcagagcgtactacgccacgaattgcggcattcatacccggcgcatcgccaccacttgttaaaactgcaatttttttaatcataatttacctacttttaaccataattgaaaatgggcataagattacatcattcaaagaatctgctctagcaaaatttgacgagattttgatctacattatttttcacaaaacagttgccatttcaaattttgtaaatgttttctttctatatccacaatgtatttttgcaaatgttgttgtactttatcgacagataaatgtttagaatgcgttggttgctgtattttctgcgaatattgaaattgcacaaagccacattggggcaattgtcgtcctttcatcacattgacttgccaagatggattttcctttgttggcgaatagatgacatatccatttaattcatttggattggtcgaattttctggaatagtatcaaaatgaaaatctttcacgtctgtattgcgataaatgcgttctcttaatgcaatacgttctttaatagaacggtcggattgattgcgatcaaagagaatttcaatttcagattgccaattttctagcgtatctggcttagatattacgcatagcgtgcatgggttcctaaatcttggctgccaganagtccataatgttggcccatatattctacctgcggtagcacattttaattgggccagcctaagttgcacagcctgaaagtataagggccgtcaaaaataacaaaattttattctttatatatcccgcttaaggacaaatccaagttcaggggaggaagctggattcaaccatacccccctatccaaatcttttactggtcaatgcgcgttaacgaattgaaaaaaaaacggcccttaatcctccgcttttttacctaaagcaaatactttgatttcccttttattggcaaaaaaccgctgaatattgggctaaaggggttttttcaaattaaatttctcagagctggtgggaaccttttcgcttggccaaaa

SEQ ID NO: 297 - DNA, 1138 bp, H. influenzae
ttgtttttgttgtttaaggctatgccctgcgcttcgcaccaagcggtaatttcttgctcggtttgggctaaaaatccggcgttgtaaatttgttcgccatattgccgataaagatattgcatcggctcaaacaaagccttgtcaaaccgtaaaggcgagatattttcggcggtaaattgggcagaacggcgatccgggcgttcgatggtgactttgtaatagccgaaatcttgattgtcaaaaatctgcgaagccaggccgactgcttcattttggctgtcggtttcgcgcgctttggcagtgaaatcaagatagttttgggtaatttcggcgatatgttcaggtacaaattcgcagtttttatcgccaaggtttttacgcaatttgcggaataagaggctggcatcaatgagctgaactttgcctttgcgtgcttcaggtttgttgttggacagcaaccaaatataagtggtaatacctgtgttataaaacaggttgttaggcagctgtacgatggcttcgagcaaatctttttcaataatatggcgacgaatgttgctttctcctgaacctgcatcgccggtaaacaggcttgagccgttatgcacggaggccactcggctgccgattttgttgtcattcggcgatttcattttgctgaccatttccattaggaatagcagctgtccatcgctggagcgtggggtagcatcaagggtttctacattgccccagtaatctggtaaggtaactttaaagcgactgtcgataacctcattgccgtctttgatataggcttgatctttgctccagcttttgccatatggcgggttggaaagcataaagtcaaagtgattaccttggaagctatctgtagcaagggttgagccgactttgatgttttcgggattatcacctttaatcatcatgtcagatttacaaatggcataggtttcatcattggtttctttaccaaacaaaaagatggaacgctcgccttgtgattcagatagcggatatttttgctcaataaagttttgcgactcggtcagcatgccaccgctgccgcaagctgggtcgtaaatcgtaataatggccggaatttggtatttgagcggatcaaagactaaatgcgtct

SEQ ID NO: 298 - DNA, 1768 bp, H. influenzae
  misc_feature (1739)..(1739): n = a, c, g, or t
gccagcttgctgcctgcagtcgactctataggaccccctataacgtaatttttgccactctcgagcaagcatacgaggcacatccctcattatatccacgagactatcatcattaatattttcctccgtcagcattttttctactttttccgccaacaaaccattaaagggggctgcgataaagccagaaaacgtggtaaaagtaaaataaaagagcaataaaatcgttaaaatcgaaagtgtcagtaaaatgacactgagaaaactaagccaatctggaataaaattcatcacccaatcaatagcactgctgatttggctaataaaaagccaaaataaaccacaaagcaaaatggtattgagcaaaattggaataataacaaaccgacgcaaacctttttgtgtgatgaaatgccagcccatcacaaaatagtggaaaccagattttaattcattaagatttaacatttttctttcctttcaataaaaatatgcttaaaacagaccgcacttttcctttaaaattccacactttgaagtattttttcacctactgaaatatggtagcattagcaccatttatagtactctcgccgaactatcgcgcgtaaggaataaaaatggatttaaatacaattttgattattgtgggtatcgtagcacttgtcgccttaatcgtacacggattatggtcaaatcgtcgtgagaaatcaaaatattttgataaagccaataaatttgaccgcacttctccaacatctagatcccatacgcaagaagaaatggtacagccaaacaatatttcgccgaatacctatgtggaaaatgggcatacaccaatttctcaaccgaccacagaaaaattaccatcagaagctgaattgatcgattatcgccaaagcgataaaagtgtggatgacatcaaaatttctattcctaacacgcaacctatttatgatatggggaatcatcgttccgagccaatacaaccaacgcaacctcaatacgatatgccaaccgcaaataatgtcgcaagtatgaccttagaacaacttgaagcacaaagtcaaaatgttggttttaatggcattaattcatcatcgccagaattaagagtgcagcttgcagaattatctcacgaagaacatcaagtagactacaacctctcgttcaatgaaccaaaagcagaaacgacagctcagccaaaacaaacaactggctatattcaactttatcttattccaaaatctagcgaagaatttaatggtgctaaattggtgcaggctcttgaaaacttgggttttatcttgggtaaagatgaaatgtatcatcgtcacttagatttaagtgtggcaagtcccgtgctttttagtgtggcaaatttagaacaacccggcacattcaatgcttataacttagcggaatttaacaccataggaattgtattatttatgcaattgccctctccaggtaataatcttgctaatttacgtatgatgatgcgtgctgcccatacattagccgaagatttacaaggtgttatactgactgaagaacaagaaatttttgatgcaaatgcagagcaagcctatcttgctcgagtgtaaattcataccttaaatttaccgcacttttatattcatttagacaggctttgtacctgtctattttcacgctaaatacatagaaaagtgcggtcatttttctccgagaattttatgacaaatatcggggtctcntagagtcgaccgcaggcagcaagtctggc

SEQ ID NO: 299 - DNA, 1607 bp, H. influenzae
tttaacgccgtatttagaacgaccttgtttacgatctttaacgcctgcacagtctaatgcaccgcgtactgtgtggtaacgcacacccggtaagtctttaacacgaccaccacggattaatacaacactgtgctcttgaaggttgtgaccttcaccaccaatataagaagttacttcaaaaccgttagttaagcggatacgacatactttacgtaacgctgagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaataatagaatgttgttcaaaaaatctacttccatatagaaatagacggcgaattttaatagttttacgctttattgtcaataattaaacaatatactctaggcttaaaactagattaaaatttaccgcacttttgttttttaataaaaaactttattccccacgttttagcatgccttgttttttcaaattaaccagaataattgaaatagcagcaggcgttatacctgaaattcggctcgcttgtccaatggaaaccggacgatgttgttctaacttcgcacgtacttcattagataatccagacactttactataatcaaaattagcaggaatagccgtattttcatggcgtttttgtttttcaatttcttcttgttgatgctcaatatagccttgatacttaatagcaatttccacttgttctacggcttctctatcttctattgcgggcttgtatggcgttaaagaagtcaaaatatcgtaggtcatttctggacggcgtaataaatcttcaccgctggcttcacgcacaagtggactgccaagcactttattggcttcttctaaatattcagaacgcggatgcagccaaatgctgcgtaagcgctggcgttcttgctcaatcttttccattttttgattaaagcgtgcccagcgagcctcatcaatcaaacctaattcatgggcaattggcgttaaacgaatatctgcattgtcttcacgtaataacaaacggtattcagcacgagaagtgaatacacgatacggttctttcgtaccgagcgtacaaaggtcatcaaccaatactccagtataagattgatcacgacgtggataccatgcctctttctcttgtacataaagacctgcgttaatccccgccaataagccttgtgccgctgcttcttcataaccggttgtaccgttaatttggcctgcgaagaataaacctgaaatagcttttgtttctaacgttggttttaaatcacgtggatcaaaataatcatattcaatggcataacccggtttaatgatgcgagctttttccaaacctttcatggaattcacaatgcccatttgtacgtcaaacggcaaactggtagaaatcccatttggatacacttcgttactggttaatccttctggttccaaatagatttgatgtgaattacgatccgcaaaacgcatcactttatcttcaatagatgggcaataa

SEQ ID NO: 300 - DNA, 1459 bp, H. influenzae
tgttatcgaaatcggactcggtacccctttacaaatttgttcattagatttctcctaaagagttttttatttagttaagtatggagaccaagctggaaatttaacttgaccatcacttcctggaagctcgccttatagcgaccatctgcagaaaccaattgtagcacctttcctaagccctgtgtagaactataaataatcataattcccatttggagagaggctgggacttttcgcctagaaaagatgtactaagtacctctgaaacgcccgttgtgagatcttgttaaactacattattgttaccattaatcatcacaagtgtttttccatctgcactaatttgcgcgctgccgcgaccacccactgctgttgcactacctccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcactcacagtatgcgctccatagcgtaaccatttatttgtcactgtatagctattttgcattaatacagcccctggcgtacctgatgcaccaaccgtatcaattaattgataagtaatactataaccattacccgatggaaccacttgtccaattacaattgcgtcaattccaatattcgaccaagcctcaggatttacctctgctgctgaagttgggcgttgaggcatttgagacaccgcaataggattaaacttaccactgttacgtaaatcatctgcaactattttgctaatatcttctggtgcagaaccaacaaatggcacgacagcaatagggcgcgcaccatcaaccccttcatcaatgacaatgcgtacttcatcgccagcgaatgcattgctttcaacagcaagtacaatcgcaaatacgctcactaaacggtttaataatttcattttgttaccttttaaaattaacattaaatctttctacagaatatcgaaaatttaagccataaattggggattataacccccatacattttttcggggtgcatcttgat

SEQ ID NO: 301 - DNA, 1526 bp, H. influenzae
  misc_feature (1470)..(1470): n = a, c, g, or t
tctttaattactgaaaccactaattatgtgcttcggattatatgcgtaatgcgaatgaacgccgtggcaatattgaggctgcattagaatctcgtcgcgagtggtataaagcaaaagcagagcagaatttatctcaacatcgtttagttgatttaagtcgagaagcggctgaattggcagaaaatgaacgtactttagaagttgatcaccaaagtgcggttgatcatcttaacttagtgttaaacgctttgcgtcaccaagaaaaaatcacgcgctatcaagaagatattgcagaactcaccgagcgtttagaagaacaaaaaatagtggttgaagatgcgaatgatgcgttagaagaaagccaagcccaatttgagcaaactgaaattgaaattgacgctgtacgagcgcaattagcagattatcaacaagcattagatgcccaacaaactcgcgcacttcaatatcaacaagccattactgcactcgaaaaggctaaaaccttgtgtggcttagctgatttaagtgttaaaaatgtagaagattatcacgcagaatttgaagcccatgctgaaagtttaacggaaactgtgcttgaacttgagcacaaaatgtctatttctgaagcggcaaaatctcagttcgataaagcgtaccaattagtatgcaaaattgccggcgaaattccacgctcgagcgcgtgggaaagtgcgaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgcagagcaagaagcgttgattgaagatatttcagcaagactttcagaacaagtggaaaaccgttctacgcttcgtcaaaaacgtgaaaatttaaccgcactttatgatgaaaatgcgcgtaaagcaccagcatggctgacagctcaagctgcattagaacgtttagagcaacaaagtggcgagacgtttgaacatagccaagatgtgatgaactttatgcaatcacaacttgtgaaagaacgtgaactcacgatgcaacgtgatcaacttgaacaaaaacgtttgcaattagatgagcaaatttctcgtttaagtcagccagatggttcagaagatccgcgtttaaatatgctggcagaacgttttggtggtgtactgctttcagagctttacgatgacgtaaccattgaagatgcgccttatttctccgcactttacggacctgcacgtcatgctattgttgtgcgtgatctcaatgcagtgcgtgaacaacttgcgcaattagaagattgccctgatgatttatatttaattgaaggcgatcctaccgcatttgacgacagcgtattgnccgcacaagaacggggtcctcctagagtcgaacctgcaggccagcaaagtcaaggc

SEQ ID NO: 302 - DNA, 1621 bp, H. influenzae
ctgttaaattccatacaacaaaaaaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataattcatattgatttacttattttaaagcccttatttataagggctttttatttatcaaggattattctgtaaaaaatatgttaaataccttaacctggagatactgccctgccttatttctatcggataggattccgtagaaccacccaacaattggcattataaggacccaaatggatcccctccgattatccccccatgaaggcgctttctccggagattgggctccccttgttaacaccccttcgcgtaatgcaacaccgcggggagccggcgtaggtgattttccccgtcacccctctc

SEQ ID NO: 303 - DNA, 2437 bp, H. influenzae
  misc_feature (2252)..(2252): n = a, c, g, or t
  misc_feature (2300)..(2300): n = a, c, g, or t
catcctcgtgtacaaaagaagcggtatgaataattcaccaaaagtagcacaagtaatgaattagatcttccaaacctaaagagcgtgctgcgagaactgcgatcaacgggcggatccgcttaccaccaccttgaacaatataaaaacctaactgtcctattagcggtacatctgaattaagctgagcaagaatattttgattaactttttgcatatctggatctgctagtatctggatctcgtctatgctcataagatcttgtttcttcatttttcatcatttatcagtcaaaagtgcggtgcattttacccgaattttcagactttctgaaatcaatccgcaaatgaagggaatttttttattttattataaataaattcttgccataggtaggatttttccgtagaatttgcgacctatttatgtgaatttttaagtgtggactgctaaaaagcaggaaaacacaattaagcggagtatttatgtacgcagttttccaaagtggcggtaaacaacaccgtgtgagcgaaggtcaagttgttcgtttagaaaaacttgaacttgcaactggcgcaacagttgagttcgattctgtgttgatggtcgttaatggtgaagatgttaaaattggtgcaccagtagttgctggcgcaaaagtagtggctgaagtaattgcacaaggtcgtggcgagaaagttaaaatcgttaaattccgtcgtcgcaaacacagccgtaaacaacaaggtcatcgtcagtggttcacagaagtgaaaatcactgggattcaagcataatttcagaggagatcaagtagatggcaactaaaaaagctggtggttcaactcgtaacggtcgcgattctgaagctaaacgccttggtgttaaacgtttcggtggcgaatctgtattagcaggtagcattattgttcgccaacgtggtactaaattccacgcaggtaacaacgtaggaatgggaagagatcacaccttattcgcaactgcagatggcacagccccactcgaagtaaaaggcgagaaaagccgtatattcgtaagtattgttactgaataatttaaatctattccattgaaacgccctaaattttgtggggcgttttgtctttttaatttcacataagcgagcaagcaatgaaacaacaacctttattaggctttacctttgcgcttattaccgctatggcttgggggtcattgcctattgccttgaaacaagttttgtctgtaatgaatgcgcaaactatcgtatggtatcgtttcattattgctgcagtttcattattggctttacttgcttataaaaaacaattacctgaattaatgaaagttcgccaatatgcgtggattatgcttattggagtaattggtcttactggcaattttctattatttagtagctcgctgaattacattgaaccgtcagttgcacaaatttttattcatttatcctcttttggaatgctcatctgtggtgtactgattttcaaagaaaaattagggttgcaccaaaagatcgggcttttcttattgttaattggtctaagtttattctttaataatcgttttgctgtattttctggactaaatcagtattcaacaggtgtcattttaagtatagggggcgctcttatttgggtcgcttatggaatggcgcaaaaattaatgttacgtaaatttaattcacaacaaatcttgctaatgatgtatttaggttgtgccatagtctttatgccgatggctgaattctcgcaagtgcaagaactcacacctttagctctgatttgttttatttactgctgtttaaataccttaattggatacggctcttatgcggaggcacttaatcgttgggatgtatcaaaagtcagtgttgttatcacacttgtacctcttttcacgatcctattttcacatattgcccattattttagcccagtagattttgcagcaccagaattgaataatattagctatattggcgcatttgttgtagtatgcggggcaattttatccgcgattggacataaattattaccgcataaaaatcattaaagtgcggtttattttggagaagttttaatgaaatttattgatgaatcccttattcgaattgaggctggggatggtggtaacggttgcgtaagtttccgtcgagagaaatttattccgaaaggcggccctgatggtggcgacggtggcgatggtggcgatgtctatttacaagccgatgaanacctcaataccttaatcgattatcgctttaataaacgctttgccgcanagcgtggagagaatggacggagttcatattgtacaggacgtcgcgggtaagatattatttaccttgtcccggggaactcgggctattgtaacgaccccaagaaccttggggattaacccacctggcaaaaaaggtgc

SEQ ID NO: 304 - DNA, 1380 bp, H. influenzae
tggtatagaatatcgactcggtaccccacaggtttattatggcgaatttgccagatattttagtttatgctcgagtaggaaatggcatggtaagccgccgtcgtggcgtcaatcaagctaaagcagaaatggcgtttgttcaaattgaaataccgtttgggaattcagggtttgttatctggattatttacttttgcattgcgttttggttctcgtttattgccaacctcgttattgaaaaaactttatcaaacttttttacgtaaataggaaatacgatgaaattaaatattttatttaaaattttgtttgatttgaggttattttagttcagaaaacaataaatataagtattgaatttacgtattatatctctgaattatcccagcgtcgctaatataatttgctcttgatcaatgtgaatccaaacctgttgcccgatttgccattgatttggctggtggaccgtggcacaaaattcaatgttgctttcagcaaattgaaggatggcttcctcttcattgagtgatttgatatttacagagaactgattcggttgatttactaatggttgttcactgatttttacccaaggtgccttgaacatcagcatcacttctttttccgtaatcagtttcaaacgagccgagctttttgtggtaatagaaacttgcaacggcgttggtaatccttgcacattcacatccacaacgcaacgagagtcaatgattcgttgttgtgccactcgcccaaaaaattgattgcgtgcgctactttgtaaagaaaaacgtgcggttgccgtgagtaaactatctaacggtacggattcatcttgtagaatatgaaacgcgtgttcttgcgtacgttctaataaatcataaagctggagcaaacgctcggcataagtggtaagcaccgtgcctccgccattttttccacctgtatttcgttccagcaatgggcgagggctgattttattcatggcttctaaatgatcccacgcacttttatagctcacttttgcatttttcgctgcttgattaatcgaaccgcattgttgaatttctttgagtaaacgaactcgttttggatcgataaaaagtgcttgttgaagtttaatcgtgagtaaaatttcggtgtttttcattttgctgtccctaagtaatcctaagtggtaagcctaagcgttatatattttactaaataatttttcttttgctatatgattgttatttatttcaatatataatcaagtaaataacgtttaatcataggagattattcatgaaaaaattaactaaaatttcaaccgcacttttaatcgcgggattaggctttttttttgcggcatccgctaaagtgactgtatttgcagccgct

SEQ ID NO: 305 - DNA, 2482 bp, H. influenzae
aatcgcagagcgtgaattgcacgacagaatgaatgattatgacccagattaatggaggggcgagatgacaaaccaagtccaacatcaacaaaataaacagccacctgcacttaaaacattttttgaaagtgcgaatgtgcaaaataagattaaggaacttgttggcaaaaatgcggcaacctttgcaacaagtgttatgcaaattgccaatagcaatgcaatgcttaaaacagcagacccaatgagcatttttaacgccgcttgtatggcagcgacattgaatttgccactacaaaatggcttaggctttgcctacatcgtccctttcagaaacaacaaggaaaagaaaaccgaagcgcaattccaaattggctataaaggctttatccaactggcacagcgtagtgggcaatttaaacgcttagtcgcattgcctgtgtacaaaaagcaacttatcaaaaaagatttcatcaatggttttgagttcgactgggagcaagagcctgaacaaaacgaaaatccaatcggctattacgcctattttaaactggtaaacgatttttcggctgaactctatatgagtcacgatgacatcgtcaaacacgctcaacgctacagccaaacattcaaaaaaggctatggcgtatggcacgataacttcgaggcaatggcattaaaaactgtaactaagttattgctatcaaaacaagctccactctctgttgaaatgcaacaagccgtattagccgaccaagccgttgtgaaagatgtagaaaatcaagagttcaactacaccgacaatattcaagaagcggaatttttagcggttgttgatgaagccacattcgaacaatgcaaacaaagcattgctaacggcgaaaccaccctacaagagctttgtgatagtggggcttatgaatttagccaagagcagattgcggagttggaggcgattgagaatggaaatgtaccaactcaaagctaaatgctctggcttggctgatttaatggtaaagcctaaaagcggtaatggaatatctgctacagcaaaaagtgcggtgagaaagatagtgaaatttgatttattcggttatcgagattttgaggggaataaatacaccgagaaaggcattgcactagaagaacaagccattaagttaagcggtcgtaaacgtggattacctcttaaaaagaacacggaaagacgtgaaaacgattggattacaggcgagtgcgatatttatgtgccaagccgaaaattaatcatagatactaaatgttcttgggatattggctcacaccctttttttgctgatgaggcggaagaaaaagccaaaaaagcggggtatgacgcacaaatgcaaggctatatgtggctatgggattgtagtgaggcgcaaattgattttgtcctcctccccaccccttacgaccaattatcaagctatgatgacccaagtcgatacattgacttagttgagcaaatcccccaagaaaaacgtatcaccaccgtcacaattaaacgtgatgagaaagtcatcgagaaaatcaaagaacgagtagaaattgctcaagaatattatcaacaacttatacaggagatgcgctaatggcacgtaataccaacaccgtgatattagtcggtcatttaggcagtgacccagaaatccgccaattccaaaatggtgggcaaattgccacatttaatctcgctatcggtgatgattaccgagataaacaaggtaatacagttaaacgtacgcattggatacctattgtggtgcatggcaattctgctgatgtagcaagacaatatctgcaaaaaggctcaaaaatctgtgtaacagggaaactggtacaggaaagctggcaagaccaaaacggcaataaccgcaccgcacttaaagtagcgacacaatcctttgaaatgctagacagcaaggcaaacaatgaaacacaacagccaagcaaagacaaagaaaaacccgacccattaagcgcagcggcagaacaagatgggtttgatgatgatattccgttttgagttacaccacaagccactaaccaatagtggcttttttattatctaaatttgagaggcaaaaatggctgaagaaaacaaagaaattatagcttataaagggtttaagcaagactggacttgtcgaggttatcagtatgaggtaggcaaaacgtatgagcataaaggtaatgttaaggcttgtgagagtggattccacgcctgcgaatacccgcttgatgtgcttagctattacagtccagcggtaagtaaatttgctgtagttaaaatgagcggcgaaacatcaaaagatagtgatgatacaaaattgcatctgcaaaatcacgatcgaaaccgaaattaacttaccggaaatgataaaaaaagccgttgaatggataaaagtaaaagtgaatgtgatgcagcccaggtttcattaagggcgattgggcggagcaaccc

SEQ ID NO: 306 - DNA, 2025 bp, H. influenzae
  misc_feature (1164)..(1164): n = a, c, g, or t
  misc_feature (1829)..(1829): n = a, c, g, or t
  misc_feature (1980)..(1980): n = a, c, g, or t
  misc_feature (2010)..(2010): n = a, c, g, or t
aagcgcttatcgcttgtcttgctccaaaccgtcgtgtagaaatcgcggtaaacggtactaaataattttagtatttgtttaacgaaagattaaatacagaaaaaggcttaaacttcggtttaggccttttgttttaaatgaatataaaaccaagcatttcaatcaagttttaacttgtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaatcacagtggaaaaataaaacccgcaataagcgggttttttatataatatgtttccctttcattattaaataatagattaagcaaactttaataccttagaaagtgcggtgaaaaatttatcgttttcttcaggtaaaccaatacttatacgtaaatgatttggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcgactttttcaataaattcatcgtcattcattacggcaactgcagcggttaatgccaaagaattacagttaaatggctgtctaactcgatttaataaatctgcgatttctggattagataccgcataaccaatgcgtaagcctgccaagccataggctttagaaagagtgcgtgaaataattaaatttgaatatttttttaataaactgaaagagtccactcgttcttcagatctagtaaattctgtgtaggcttcatctaataccacgattacattttcggngacttttgctaaaaaatcttcaatttcttgtgatgttaaaaaattacccgttggattattgggattagcaatgtaaatgagctttgttttatcagaaagtgcggttaaaaatccttgtaaatcgtgtccccaatttttagctggaatttcttttgcaattgcatttatcgctttagtcactaaaggataaacaataaaagcatattgtgaataaatgatttcatcgccttccgttgcgaaagtgtgagcaaaaagttctaataaatcatttgagccattaccgagtgtaatttgatttggttgaacgccaaatttttttgcgatagtttgttttagttcaaagccattcgcatctggataacgagtcagtttatctaattgttcgaaaattgctttttttgcactttctggaaaaccaaatgggttttcgtttgaggcaagtttaacgatattggaaataccaatttctcgttctaattcttcaatcggtttaccagcttggtaaggtgataaggattttacgccacgattggcaatgttaatgtactgcatagtgttatttgtaaatattgatatgggttagtatgtatttttaaataaatttgggcgtagtaaatacgcccattggaaatatttttcctattgaggaagattttcagcttcanattttttcataaatgaaatgagtgcctcaacaccattttgcgacattgcattataaatagatgcgcgcattccaccctaaaccttatgaccctttcaaggcttgcaaacccgtagcagtagattctgcgacaaattttgcatctaattcangattacctgtgatgaaagtgacattcatgntgaacgtttttcttt

SEQ ID NO: 307 - DNA, 1803 bp, H. influenzae
  misc_feature (1443)..(1443): n = a, c, g, or t
atcccctctactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatcttcgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataagtctaggagatagagatggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcgcaaaaaactcgtgctgaagtgtctggttcgggtaaaaaaccttggcgtcaaaaaggtacaggtcgtgctcgtgctggtgatattaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaaaactaaagttttagtacaaaaattaaaagatttagccgttgaagatgcgttaattatcacagcaagtttagatgaaaatctattcttagccgcacgtaacttatataaagttgatgtacgtgatgttcaaggtatcgatccatttttcttaatcgctttcgataaagtgattgttactgttgatgctgtgaaacaaattgaggagatcctagcatgagtcaagaacgtttgctaagtgtgctacgtgcaccgcacatctctgaaaaagcaactaacaatgctgaaaaatctagcactgttgtacttatagttgctttagatgcgaccaaagctgaaattgctgctgcggctgctcaattatttgaagtaaaagtagattcagtccgtactgaggttgttaaagggaaaactaaacgccgcggaaacaaattgggtcgccgcaccgactgggaaaaagcttatgtaactttagccgaaggccaaaacttggacttcgtggacagtgcacagtcatcggaggagattagagaatggctatcgntaaatggaagccgacctccgctggtcgccgtcacgttgttaaaatcgggaacccctgtttacacaggggttaaccttacgcacctctgctaatactaaatctcaaatggggggcgaacaactatggtcgtattactactcggcacattgggggcgggtcccaacagcactcccgtttatatgattcagaccgtacaagtacgcattccagcggtgggtgggcggtaaaaaaagaacccacccgtcggcaaccctgtttaagggcttaaaagaggggcacgccgtatattttaccctaagggttgccgggggcgatcagtcctacgcggtcactacccatgagagggggccttctaccagc

SEQ ID NO: 308 - DNA, 1326 bp, H. influenzae
attcccctcatcttgaatgtttgatacgcaattaattacagaaaaactttgtgatgggaacgaataattttcctttgatggctattcctttctttatgcttactggagaaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggcaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatttttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcggattttttcctggaattggaaattgttccaatggattggttatcttgattattaagggaagttgcctcatgaaaaaattaccttttatcgggagtgtatggagggacttcgtgggaaccccttgtcggcaatgtggccaaattttggtgggggatacctctaattcgtcgatttatgttaggcgaggc

SEQ ID NO: 309 - DNA, 1366 bp, H. influenzae
cgaattacgcaatatgtcaattttaatgatcgcgcttggcacgcaggcgtatctaattttcaaggacgagaaaaatgtaatgattttgccattggaattgagctggaggggagtaatgaacagccttttaccgacgctcaatatttttcattgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgtataaaaattaaacatcaaattttgatgtattctgtgtattataaatgcgttcactcttttaattctaactagttgaattaaaaggaataaatttaaatctgaaattttattaaaaaagttaatttgagttatacaacattatagattttctcaaccacaattttatccacagaaatattgaataactcaaagagatgataaaaagatcttttgtgaataaaactgttttaaaaattgtatttttttaccgcactttcttccattttgaatgtgaaaagtgcggtttatttttgtttaagatcttttggttgtaaataactcaatttattttgaagtttgatgtgataaggatctttgcctgtttttacgagatcaattcacaatcagaaatccgttattcacaatgttatccacaacataggtacttttcgtcatataaacaaaataagaatattttgttgtctagaagtttcccctctccgtaaaattgtgtatttttaaccgcactttaggttcaaacccaatgtgcagttatttttattgattttcctcttttcgctttttgctcttttttttaaaatatgatactttttcgccgtcaataagacatcaaacacaaatcaatatgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattggaagatcaacaagatttaaatacttgtttaaacacaattattgaatccgcacattctcgttttcctgtgattgccgatgccgatgaccgcgataataatcgtgggcattttgcacgcaaaagattattaaatttttacgtgaagatgccgaagcatttgattaatcttcttattgccccccgccggattgga

SEQ ID NO: 310 - DNA, 1400 bp, H. influenzae
tggttacgatatcggctcggtaccctggttttcacgaacttgccgatgcgcaagacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaaaggtaaaagtgcggtaaaaattgttatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtgactaaagcgtatccttttccgcgtaaagttttaaaccaagagggcttgttttttcgttctggtaatttgcgtcttaaattagagatgtgcatatcaagagaacggtcaaatggagtgagtggtttttccatcacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgcggtattatttgaaggagatacactacgacgcaaaatcgccttaattcttgcaataagctcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgcggtgaaaataaaaagattatttccagaatttccaccagcttgattttggtttctcacctgtttcaataatggtgttattttcgcccttgttgtgaaacctgtggtaaaggttttcaagatggggttttctgggtaccgaaggcccgaattac

SEQ ID NO: 311 - DNA, 1544 bp, H. influenzae
tgttttcgaattcggactcggtacccggcccctctggcggcgatatccatacagggcgtgcaaatgcaattaaagtgttagcgcgagtattagcaaaactttctcaaaatcaaccgcactttgctctctctgatattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagcactcaaacggttattaacgcactcaacgtattaccaaatggcgtaatccgcaatagtgatgtagttaaaaatgttgtagaaagttcattaagcgttggcgtattgaaaacagaaggtaatgttgtaaaaagcactattttagttcgttcattaattgaaagcggtaaatattacgtaactgaaatgctcagctcacttgcaatcttagcaaatgcaaaagtcgagttttctgcaccttatccgggctggcaacctgtaaatgactcaactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatccgaaatgctcactcaccagatgaaaaagtggaaatcgcaacagtacaaacctattgggatttattgacaagagtacttgccgatattcctgcgaagtaatctaatattaattaaaagtgcggttaaaatttcttttgttttaaccgctcttttatttttttcgtttcgctcttgggtgcgcctgatcgtacacttctgctagatgttggaaatttaagtgagtataaatttgtgtggtggaaaggttgctatgcccaagcaattcttgcacggcgcgtaaatcagaactggcttccaacatatgcgtcgcaaaagaatgacgtaatttgtgcggattaagatggctatttaagccttgacgaataccccaagtttctaaacgtttttgaatggctcgatgagaaatacgatttccaagctggctaacaaataatgcctcatcttttgggttaaataatgcccgcacttttaaccattcttgaatagcatgcgaagcataacgtccaaacggcacaactcgttctttgttaccttttccaataacgcgtacttcccgcacacgggtattaatgctgtttaaatctaagccttgtaattcagataaacgcaaacctgaactatacattaattccaaaatagcacgatcacgaatatcaataggttctttgctatcgttggcaagcaattgttgaatttgctcgccatccatatttttcggtaaatgccagcctgtttcggtgcagaaatgcctgtggcaggatttacttttaattcgccttgttgcactaaaaaactgag

SEQ ID NO: 312 - DNA, 3226 bp, H. influenzae
  misc_feature (3219)..(3219): n = a, c, g, or t
  misc_feature (3223)..(3223): n = a, c, g, or t
ggaattcggctcggtaccccgaacaatattaccgctcggcggtaatgtattcccataaagcaacggaagaatacccagaaattgccttaatgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctttaatcattaaccgaccgctaaagtgcggtcattttttaggagaattttatggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtggggtggttaaatcggcgaaacttgagcttggaaaagaagtgggttctcgcgagtggacgcttgaaactgcggacggtaaattatttgtagggggaaatgactgatggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcgtaagcgttggtaaatacagcgaacagacgctaagtgagatgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccgatgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattttgttgggctaatggtgctgggcggtatntttnccg

SEQ ID NO: 313 - DNA, 1955 bp, H. influenzae
gagacccctcagtttcgattaaatacataaattttttaattgctgtctgatttggtttaagccgtttaaacgcatttcacttaaacgttgtgaaatgccgagttcgctaaaaaaggcaataatatcaaatgtattcaattcatccgctgttttgccattgatttgattgaataaaatccaaagcaagccattcataattctggcttcgctaaatccgctgaattgaaaagtgcggtcatgtttaggcataatttgaaaccacatttgtgcttcgcagccagtaataggttgcatttgagcgagttcattatcgcttgggcgaggtaaatttttgcctgcttgaataatcaggcgatagcgatcttcccaatttttagcttgttttaattgttctatcattgtaataaatccagtgctttatctaaggcggtaaagaatgcctctacatctttttgcgtattataaggcgcaaaagaaagacgcaatgtggtgcgttcgcctaagcgtgctaaataaggctgggcgcaatgttcgcccacacgaagcgcaatattttgttcgctcaaaagtgtagaaagatcagaacagtcaatgccgtcaaatacaaagcaaacgacagtgcttgcttgaggagaattgaataatcggcaattctcgtaagattttaaccgcactttgacggattcagccaaggatatagcgtactgttctgctgcggtaaaatcccatttttgtagccaatccagcacagcattaaagccaataaccccagcaatattgggtgtgccagcttctaaacgataaggcaattcggcaaaagtaatacgattatttgacacacgttcaaccatttttccgccaaaaaagagcggttgaagttgagaaagtgcggtcaattttcctgttaaaacgccaagtccatttgggccataaattttatgggcagaaaatgcgaggaaatcggcatctaaatcttgtaaatcaattttaatatgactaatcgcttgtgctgcatccactaaaaccaacgcatgactatgttttctaataagttgaatcaggcgtttaatcggctgttctgtgcccgtgacatttgaaacaaaattcagcgcaacgagttttgttttttcagaaagggtagaaataagcacattttcatcaattagccaattatctaaaatcggtaaaactcgaatttttgcaccgcactttttcgccgtttcatgccaagtgacaaaattggcatgatgatctgcttggctaatcagaatttcatcttcggcgtttaattgcggcagcaatccatttgccactaagtttattgcgtgagttgtacccgaagtccaaataacagcgtgtttatcttctgcatgaacccattctttaacctgtgtgcgagcctgttcatattgcacagtttgggcagcatcatattggctgcgatgcaccgaacctgcagacgcataaaattcagcggtgcgatcaattaacacttgaggttttaacgcggtggcggcgttatctaaataaataacagaatcttcacgttggaaatagggaaattcttgacggaacgtttgataatcaaaagccatattaatttttctcttgtctgcgccattgacttggttcaatcggattattatctgcccaaagaccaattcctttggcttgtgcattttcttgcgcttgaagataaatcggatcatgggaatattgtttataagcccatgccataccctgtttaaccatttctaaattaatatttttatcttgataataaacaatcgcgaaagggtcgttgatagcgaatctttccttttagtgaaagacgtacgtttttttgataaaccagatagacagggttttttcgatttttgccaaaggcttgagatttttctgcgcatcaattccggtaaacgaccttaatggattatttgctttaggaggcaggg

SEQ ID NO: 314 - DNA, 2368 bp, H. influenzae
  misc_feature (2340)..(2340): n = a, c, g, or t
ctttttacagtttaactcgctatgatgatctcaattagatcatctttttctatgctataatccctcaaaattttcaaaatcggtacctaaatgaaacaattatttgcaacgacttctcgtggctttgaagaattattaaaagttgaactcactgaacttggtgcgcaagaggcaaaagtggttcaaggtggcgttcattatcaagcagatgacgaaactttataccgcactttactttggtcacgccttgcttcacgcattttatttcctttgattgaaactaaaatttacagtgatttggatctttatgcggctgtttcaggctttaattggttagggctatttgatgaaagagttacattctttgtcgattttaatggaaccaaccaagaaattcgtcatactcaatttggtgcgatgcgcgttaaagatggaattgtcgattactttgaacgtcaaggtaaagctcgtcccgatgtagataaaattcagccggacgtgcgtatccatgcttatttgaatcgtgaaaatttagtgatttctttagatttaagtggggaagcattacatttacgaggctatcgtgaagatgcaggtcaagctcctttacgtgaaactctagctgcggcaattgttctgcgttcaggttggcaagtgggttctccattagtagatccaatgtgtggctctggcacgcttttaattgaggcggcacaaatggaagccaaaattgcaccgcaactttatcgtttacattggggatttgatttttggaaagcgcataatcaatcggcttgggaaaaagtaaaaaatgaagcgattgaattagcagaagaaaaacaacgtgaaattcaaccgcacttttatggatttgacctcgatcaccgcgtattaaaaaaggcgcaaaagaatgcacaaaatgcaggtgtttcacatttaattaaatggcagcaaggtgatgttgcagcgttgaaaaatcctcgtttaaatgaagtcggtacggttatctgtaatccaccttatggggaacgcttaggcacaaccccagcattgatcgcgctctattctgtatttgggcaaagacttaaaaaagaattttgtggttggaatgtttctgtttttagtagcgaatccacattacttgattgtttgagaatgcgtgccagccgacagtttaaagccaaaaatggcccattagattgtgtgcagaagaattatcaagtttcagaacgaaaatctgacgaaattaccgctgaaaatgaactagaatttaaccgcacttcggaggttgcaaccgattttgctaatcgattacaaaaaaatattaagaaaattagtaaatgggcaaagcaacaaggattagacgcttatcgtttatatgatgccgatttgccagaatataatttagccgttgatcgttatgcagattacattgttgtgcaagaatatgcagcaccgaaaaatattgatgaaaataaagcgcgtcagcgtttgttagatgcggttactgcaactttgcacgttacaggtgtagaaacgaataagttgatcctcaaagttcgtcagaaacaaaaaggtactaaccaatatgagaaattagccaataaaggcgaatacttttatgtgaatgaatatggcgcgcagctttgggtaaatttgacagattatttagacacgggcttatttttagatcaccgtttaacaagaaaaatgattggagcgttggcaaaaggtaaagatttcttaaatttatttgcttatactggttctgcaactgttcatgcggcacttggtggcgctaaatcgacaacgaccgttgatatgtccaatacttatcttaattgggcggagcaaaatcttattttgaatgatattgaaggtaaacaacataaattaattcaagcagattgccttcaatggttagaaaaatgtgatcgtcaatttgatttgatatttgtggatccaccgacgttttcaaattctaaacgtatggaagacagttgggatgtgcaacgagatcatgtgaaattaatgcgcaatctaaaacgagttttgtcgaataatggcacaattgttttctcgaataataaacgtggattcaaaatgaatttagttgcgttggaagaattaggtttaagtgcggtagaaatttcgcataaaaccttaccgttagattttgaacgtaataaacaaattcataattgttggatgattcaacatatataatgatttgccaagttgtaaaaatagtcgaaaaaatagtgaattttaaacaaactgaataaaaaactatcgctcaaacatttttttcaaaaagtgctagacaaggttttatgaatncgggtaccgagtccgatatggtatacca

SEQ ID NO: 315 - DNA, 2385 bp, H. influenzae
  misc_feature (2344)..(2344): n = a, c, g, or t
agggggatccccatcaggtaattttacagaaagtgcggaaggcgatttatctgcactaattagtaacagcgtttttccgcttgctttaattcgattgaatagatcaaaaatagctaattcccattcatcatttcctatgacgctttgtaaatcatctaagcataccaattcttgctgttctaaattttcaagaactgcggtagaaaaatattgagatttgctaaggggtacataaatagcagtacgttgattgattaaatattcgttactgaatgctctaagtaaatgggttttaccagagcctttatctccccaaatgtagaaaaacggttgttttaaatcagatgaatttttgcgtaaagaatcaagcaataaaagattattatcgccgtaaaagttttctaatgtggcatcattaatttgatgaatgggtaagggaagctgtttattcaaatgtttatgtagtacagattaagtaagaaagggctaaatgataatttaaccctttgaaatgaggattattctacttcattttttgctttcggtaaaacaaggtttaagatgatagcaacaatcgcacataagctgataccttttagtgatacgttacccacatctacaaacatattgccgataccaaatgtcattacaacagaaataatacatagattacgcgcttcggtaacatcaactttgccacgaattaaggtgctaatgcccacgactgcgattgaaccgaaaacaagcatcataattccacccattacaatcgttggaatggttgataggaatgcgcctacttttccacagaatgaaatcgcaatagcccaaacagcagcccaagtcataatatttgggttaaagttgcgtgttagcatcacagcaccagtaacttccgcataagtcgtattaggcggaccgcccactaaagaagctgcagcagtagcgacgccatcgcctaataaagtgcggtgtaatcctggtttttttagaaaatctttacctgtcacagagctaatcgccataataccaccaacgtgttctacggcaggggcaatagcaattggtaacatataaagaatagcttctaggttaaattcaggtgtcgttaatttgggcaaactgaaccaaggtgcatcaataactggttggaaattaattaaacccagaaacaaacacaaaatatagcctacggtaataccgaacattattggaataagtttcatcaatcctttggcaaatacagccacagataaagtggtaagaagcgttaccattgaaactaatactgcgtcgttataagcatagttactggttttacctaatgacatatccaccgcaataggtgcaagccccatgccaatgataataattactggcccaacaccactggtgggaaaaaacgttgtagtgcttctgctccccgtaattttactaacgtactcaaggcgaaataaacaagcccagtaaacgctaaaccgcccatcgtagtcgcaataccccaagtttgaacaccatattgaatgggcgcgataaaggcaaaagatgatgccaagaaaataggcacttgtttgcctgtacaaaattggaaaagtagagtgccaacgcctgctgttaataatgccgtattggaatcaagtcctgtaattaatggtacaagaacaagcgcaccaaatgcgacgaagagcatttgtaggccaacgaaagattgttttaatttgctttgattttccgaaggaaaagaagaagtttggtttgtcatttagtttcaactctctgtttgaattaacttaaaagtgcggtcagtttttcttgtgtttcacgcacggaaaaaagacggcttaaatgccgtcttgttttggggattattttgtcccaaaaattttatcgcccgcgtcaccaagacccggaataatgtaaccttgttcatttaaatggctatcaatagaagcgcagtagagttcaatgtcagggtgcgcagcctcaagagccttaattccttctggtgcagccactaacactaatactttgatatgtttacaaccttttgcttttaaaagatcgagggtggcaatcatagaaccgcctgttgcaagcattggatcgacaacaattgcaagacgttcttctaaatcgctagctaatttttgaaaataagggactggcttaagggtttcttcattacggtagattcccactacactgatacgcgcgcttggtacatgttcaagtacaccatccatcatacctaaaccagcacgtaaaattggcacaaccgttacttttttacctttaattcgatcaatttctacagggccattccaactgggtgatcgttactttntcagtttctaaatcagaagttgcttcatagggttataggct

SEQ ID NO: 316 - DNA, 1721 bp, H. influenzae
ttcaagtgctgatactctacgacgttatcttgtttagtcacaccgatacgacgacaaaattcacgtaacgaagctggtgtataaccacgacggcgtaaacctgaaatggttggcatacgtggatcgttccaaccatccacgatttcatcatttaccaatttcaataatttacgtttagaggttaaagtgccttctaaattcaaacgtgagaattcatattgatgcggtaatggacgttcaatactgatattttccaacacccagtcatataaacgacggttatcttggaattctaatgtacagattgagtgtgtaatacgctcaatcgcatcagagatacagtgcgtgaaatcgtacattgggtaaatacaccatttgtcacctgtttggtgatggctggcaaatttaatacgataaattactggatcacgcatgaccataaatggcgaagccatatcaatttttgcacgtaaacttgctttaccctcggcaaattcgccatttttcattttttcaaataacgctaagttttcttcaatagtgcggtcacgatatgggctgtttttaccaggttcggttaaggtaccacgatattcacgcatttcatctggagaaagctcatcaacataagccaaaccttttttaattaattcagcggcatagccataaagcgcatcgaagtaatcagatgcataacgcggttcgccctcccatttaaaacctaaccattccacatccgctttgatagaatctacatattccacgtcttcttttactggattggtatcgtcaaaacgtaggttacataaaccttggtattcttttgccaagccaaaattcaagcaaatagactttgcgtgaccaatatgcaaataaccattcggctctggcggaaaacgggtatgaacgcttttatgtttacccgaagctaaatcttcatcaataatttgggtaataaaattatgagtgcgggtattttctgcacccaaagatgtctctgtatggctcatcattttctctcgttaaaataaaaaaatattcggctattctatacaaatctaagggaaaataaaggttcatctcctgttcttgccatagaaatactagatttaaataaaagattgtaaaaacttgccataaaaaaccgccacgaaattatcgtggcgatgtataaatgcacaaagtgcggtaagttttttgaatgtttagcttaccaaacccagccagctcccatttgataggaaattttgctgtttttgcctgcattcacggcgataccgctttttaatgtgatgtagtggagggaggcgtatcaactaaagctgcctaattttacgtcatatagataaaatataaaggaaatattgtttttataaataaaaagtgcggtgaaagtctcaaaaatttttaccgcactttattgaaatagagtttacattacaaccacatcaaactgttcttggttataaaactggtactgcttttacttttactcggtttccaataaacatttccacttctggcagtaaaccgtgagattcttcattaataagatattctgaaactgctggcgaggcataaacaacaaattggtcactactgaataaatgatacaccccgataatttcacgcataatttcgtagcaaactgtctcaacagttttcacccgaccacgtccattgacagtttggacattcatcgcataacacgtgtttcaagg

SEQ ID NO: 317 - DNA, 2200 bp, H. influenzae
ccagacttggcatgcctggcaggtcgactcttggagatcccccaagttaagaaaatcaatgcaccaatagaaagcataataatttcaatggtatgtgccattcccattggttttccatcaaaaacaggtcgaatagaaggagctgcacccattaacacgacaagtaaagctccaaataagaataaagaaacagaaattttagctgttttgctcacttctacttctttgactaaagtggtagaagcaaaaatatctgcatattttggatcattcaaacgacgttgatattctggatcatcttttaattctttacccattttattaacaaataagcaagcaaggaaaagtcctagaatagttgaaggaatggttaccattaaaacatcgccaagatgaataccttgtggctcaaggtaagcaaccacagccaccactgctgcagcgattgggcttgctacgatagcaaattgtgatgcaattaccgccattgacattgggcgttcaggacggataccgttttgacggctcacttcagcgataactggcaatacagaatatgccacgtgaccagtacccgctaagagagtgaataaccaagttactgctggcgcaataaacgtaatgtgtttaggattacgacgtaagattttggttgcgattttgatcatgtagtctaaaccgccagctgcttgcattgctgccgcggctgccactacagccataatcataaacataacatcaataggtaaacctgctggtttcaagccaaagccaaaagaaagaatgggcaagacctaaaccaccaaatacacctaaaccgataccacctacacgtgcacccacaaagatacacattaatacgatggccaaattgcaggaggaacattgcagacatactgaccccctaagttaatagaaaaacactttattttatttgttgaaacggcgtgtaatatagcaacaaataggtagagattccataacttggatcaataaataatgttgaaaaattctgttattttccatcagctgaaataaagataatttaatgtattctatattttgaatatttttttgaaagataacccaagtgcggttatacttgagccctattttgacgtacttaatcagtagagaaaacaatgcaagaatttatctcaatggcaacagagtttgctcaaaaacatacgcttttagcagtttcttggtttgcgattttcgtgatggtgatttataccttctacaaaggcgcaacgagtaaatttaaagtaattacgcacaatgaagttattcggttaataaattccgatgaagccattgtggtagatttacgtagtcttgaagaatttcaacgtggacatatcattaatagtattaatgtgcttccaagcgaaattaaaaatcaaaatatcggaaaattagagtcgcataaagagaaagctcttatattagtcgatacaaatggtacttcagcctctgcttctgcagtatttttaaccaaacaaggttttaattctgtatttgtgttgaaagaaggcctttccgcgtgggtagcagcaaatttacctttagttaaaaaacataaataataaggaatagaaaatgtcagaacaaaaacaagacgttgcagcaacagaagaacaacaacccgttctccaaattcaacgtatttatgtgaaagatgtgtcttttgaagctccaaatcttccacatattttccaacaagaatggaaaccaaaacttggttttgatttaagcaccgaaacaacccaagttggcgatgacttatatgaagtggtattaaacatttctgttgaaactacacttgaagatagtggtgatgtcgcatttatttgtgaagtaaaacaagcgggcgtattcactattagcggtttagaagatgttcaaatggcgcattgtttaacctctcaatgcccgaatatgcttttcccttatgcacgtgaattagtgtctaacctagtcaatcgcggtacgttccctgcattaaacttatctccagtaaactttgatgcattgtttgttgaatatatgaatcgccaacaagcagaaaatgcagaagaaaaatctgaggaagaacaaactaaacattaattaaatggtaaaacaaaaggcaagctagaaatgatctgcaccccaaaagctggactaaataacgggtaccgagtccgaatcgtatacc

SEQ ID NO: 318 - DNA, 1413 bp, H. influenzae
cctagtaaagctacacctaacattggcaaagcggctatttctatcggagcctgccaacgtgttacagcctcaataaaaatccaaatagcgacccaaactaatgaaattccattgattaaagctaaccatttttgccattttagacttaaaaataacccaatccatgctaaaaaaatagataaactatcatttgccatatgcccagcatcagccatcaaagtaagggctgttaaaccaatatccccctagaaattcacaccatataaaaggtaataattgcaaaactgatgcctaataccattttatttttagaaatttgactatgagggcaagatgcatgctgctgatattctttaggagtataattttttactagagaaacttctttcattttatttccttaactatttgatttgaaagaagcataaaacctgtagtaactacaaagtcaaatcataaaacttacatttaataaaattaattatttaaaaaaagctaaattatagagatttcaataaaaattcatttttatctgtggataactcataaataatctgtcataaaactgtttttactcacttgataactttgagaaaaaataaagttgttaataactttccattttacacacaagatttttaaagaaaatgatcgcattttcacaagatctttagatcctataacaccagtttccgtaaggatctaataagtttactcacaattacaaaggatcttaatagtaacaataataagatctttatatataaaaaaagagatcttatttactaatacaaacctgatctttcaaaggatcaatagatccattctttttttgtcaggtgttttaaatttctgtagaataacgccaattttttgatccgaataaatagagatagatatgttttacactgaaacttatgatgtgattgtgatcggtggtggccatgcgggtacagaagctgcgcttgcaccagctcgaatgggattaaaaacccttttattaacacataatgtagatactttagggcaaatgtcttgtaatcctgcaattggtgggatcggtaaaggtcatttagtaaaagaagtagatgctatgggtggtttgatggcgcatgctgcagataaagcaggaattcaatttcgtactttaaatagtagtaaaggtccagcagtacgtgctactcgagctcaagctgacagagttttatatcgtcaagctgttcgtacagcattagaaaatcaacctaatttagatattttccaacaagaagcgacagatattctaattgagcaagatcgagttacaggcgttagcacaaaaatgggattaatttttcgtgctaaatcagtggtattaactgcaggtactttcttagccggtaaaatcatatttggtttggaaaattatgaagg

SEQ ID NO: 319 - DNA, 2207 bp, H. influenzae
  misc_feature (2121)..(2121): n = a, c, g, or t
cagtgtttttatcgcccaagcccgtaccaagatacgtgaacattttgttttgctgtcgcacgccaggtacgcaccaagcgacttttgtaatttgaaaatgctgacaggaaacgcatatttggcacgtgtggtccacggcacatatcaatatattctaagtgatgatataacgcaggcgttgcagtacgttcaatgttttcatctaaaattgccattttgtatggctcgccgcgtttttcaaaggtatcacgcgcttcttgccaagtaacacgttttttcacgacgtcataatttgtttttgccaattccaacatacgtttttcgattgcatcaatatcttcttgggttaaagagcgatctaaatctacatcataatagaagccgttttcaatagttggaccaattgccatttttacatctgggaataattgtttaatagcgtgtccgagcaagtgagcgcaagaatggcggataatctctaaaccgtcttcatcttttgcagtaataatttctaacgttgcatcttgctcgataacatcgcacgcatcgcgacgttctccgtttacacggcctgcgatagtggctttagcaagacccgcaccaatatcttgtgcgacttcaagaacagaaacaggacgatcgaattgacgttgggaaccgtcaggtaaagtaataattggcattgttttttccttatacagtggtcacccatacgaaaggtgacgtgttcatttaaaattctatcaaaattaaccgcacttttgccctacttggcttcattcctaccattgaacgagcgaaattaggcaaaaaatgcgtggcgaattctatcactttcttgaagtattgttaaataaatgcccatattttacaaaaaggaaataatgtttttctgactaaaggctttatctcttaaaaataaagactagaataaccgcacttttaactaggtagcaaggaataaaaatgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctttaatcctcagataatctaaaaaatataagaaaatgtattaaaaacaaaaaagtgcggtgattttaccgcacttttcttcttatttctttcgttcaacccattttccattggtgaaatcaacaatccatttagtcgcttttccctctttttcagaagtgacatattgttttttctctttgcgactaaaacgaacaatcgcttcattctcttctgggtctttttgtggagcatcggctaaataagctaatttttcaggtaaacgctcgcgatattgcacaagttcagcgattttaactgggcgtgtttcgcgggattttgggaagttatgtgctgacataaataccccactcgcaccatcacgcaatacaaaatatgcatcagatttttcgcattttaactcagggaaatgtactggctcttctttcggtggtgcgacctcgccacttttcaaaattttgcgcgtgttatcacaatttgtacatcccatatacttgccaaaacgaccaagttttaaatgcatatccgcaccgcatttatcacactcaacaacagggccatcataacctttaattntgaatgagccttcttcaattaaatatccatcacaatttggattattaccgcaatatggattttacgatgtgcatcgattacatagc

SEQ ID NO: 320 - DNA, 1964 bp, H. influenzae
tggtatacgaatatcagactcggtacccttctaaactgtcacgtttgctttgcgtttaaacgtggagagttcggcattgacacttgccatgccctcaattaaggcatcttgtaaacgttgtgtagtaatggtgccgtctgcacggtattgattacgaaattgggaaagtgacatatcggggaagaaaccatcattactgataatgtcatctgacgtatcgtaatcatttaactgttgctgcacttcgcccatttcataatcaggggccagtttgactgatattgcgccgtcgctcattgatttacccttataaaaaaagtcgggtgaggattaaattaagcacggccaataaatccgtcagaatttgaccgcacttttaatccgcccgacggctgcgtggtttgctcggtttatattctttcttgtttgtgcaagaaagaaccaaagaacacaccccgattaaatcgcttttctgccctttgttgtcattttcttaacggaaaatttttaactcgctacgctcaaacaagaaaaattttcctaaaaatgccaagtcggtcaggcgatttagacggggcattaaaacaacatcaacattcagtcgctgataattgtttttttagtttcttgatgtcgcctttcacgccaattttttgatctaaacccaaagcacgttctaaatatgccagtgcttgctcagggtgtttttcaaccaataacaaacccaattcacgcaataatcgcgctcggctttcatctggcatatcgcaatcggcggtgatgcgttggacttgctctaagtaagccacttcgaacggtttattggcagcttgtgcggctttggcttggtcggcaaattcttctgctaacaaggtgccaagtgttcgagtgaatggctcgggcaagcgtaaatcatgaaatacggcataatcggcaatttgtaaggcgagatgatattcgccacagtcaatcgcccacacgcaccatgtcatcaagacattatcttgtttaccacttccgaccgataacgccccttcaatccatggtagatagtcaggcaaaatttgctttttaaatgcgcctttgcgttccgtcgattggatgtttttcaaatcctttcgatggcgagcaagaatacggcacattttttcatattccgtaaagtcgcttagatcttcggtttctgccgcattagcgatagcggcagaaacttccagaaagtggcgtttagttgggcgcataattgattccgttatgcagccactggcgaaataggcgtaggtgcttcaagaatggtgatatttttcgccatggcgactgcctcgtagttttccacaacataggcttcgtttgacgataaataatcttccacacgattgcgttctggtacatcttttaagtgacgacgtactttgccttcctgcacgtagattgacaagttatcaagcgatgtgactaacactgtgcctttcgggaagaatgggacagatacggcttgtaacccacccacacgtttttggctaatgacggtatcgcctgccaaaatttcgcttggtttttcttggttgattaatgggaagtatttatccgctactaatttctcacccattatcgttaccggttttttttattcccattctcgcagctttagttaatccctctttcgctgtgttccttcctcgcttttttttccccccgtctttttctttccactcgttttctcctctcttttttctccgtctcgtcccctttcctttcctcttcctgcttatcgtttgtcccccttcctctcttttcccctcttcttttactaaatcccctctgcgcgcttctttcctttgtttccccctttccctccccttttctcctatccccttctatcctaatctttccccgcccttatcttttccatttctcctttacacttttcccttccttttccctttatttttattccttttctt

SEQ ID NO: 321 - DNA, 1782 bp, H. influenzae
tgttttcgaattcagactcggtacccttagtttggaaagccggtttaggcggcttgatgaaacaagcccaacaaatgcaagaaaaatgcaaaaatgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttttaatcgaacacttgtcttcccctgcttgcgagggaaggtgtcgcaaagcgacggaagggggttccccctaagtcttcggtattcccccgtaaatagagggagcggaaagtagccttatatttcatctcaaattatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgactaatcttctcataccattatgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaaccctgtgctagttttatatgtccgtcgagatttagaattgagcatttccagccaaagacttctttgaagtcagcttgggttc

SEQ ID NO: 322 - DNA, 2279 bp, H. influenzae
  misc_feature (2226)..(2226): n = a, c, g, or t
  misc_feature (2239)..(2240): n = a, c, g, or t
ttccgttccaaggtttcgaccatgatagatgttggatcagccacaccaatcgcataagaaagttggatttcacaacgatctgctaaacctgctgccacaatattttttgcgacataacgtgcagcataagccgctgaacgatctactttagatggatcttttcctgagaatgcgccaccaccgtgacgagcagcaccaccgtaagtatccacgataattttacgaccagttaaaccacaatcccccatcggtccaccaataacaaaacgaccagtcgggttgatgaagaattttgtttctttagaaagccattcagttggtaatacaggtttgataatttcttccatcacaccttcgtgtaaatctttttggctaacttcttcagaatgttgagtagaaagtacaaccgcatccacaccaacaattttattatcttcatattttaacgtgacttggcttttcgcatctgggcgtaaccatgctaatttaccgcttttacgcacttcagcttgtttttccattaaacgatgtgcataagtaatagctgcaggcattaatacatccgtttcattggtggcataaccaaacataataccttggtcgcctgcaccttgatctaatggattttcacgatcaacgccttgattaatatctgcagattgtttaccaatcgcattaagcaccgcacaagaatgaccatcaaaacccatttcagaatgttcataaccaatatcacaaatcactttacgggttaaattctcaatatcaacccacgcagaggttgtgatttccccacccaccaatgccataccggtttttacgtaagtttcacaagctactcgtgcttttggatcttgttttaggatttcatcaagtactgcatcagaaatttgatcggcaattttatctggatgcccttcagagacagattcagatgtaaataaatagctagacatattttctctcttcttcttttaaatttggatgtattgacgtatagacggctataatacgcatttttgcttaataagcaagcggtattatgggttagttgagggaggaatcgccaaccaattacgcaaaattttctcgccaaagtctgacatataagattctggatgaaactggacactataaattggcaaagatttatgttgcattgccatcaccacgccttcatcgcaaagtgcggtaacttctaggcaatcaggaaaatcttcttcctgtacgccccaagaatgatatagcccgatattaaattcagttggaagatcaaaaaacaatggagaatttgaccgcacttttaatgttcgtttctgcccgtgacgaacattctctaagttatacaatgtaccaccaaaaaattcacataaggtttgatgccctaaacacacacctaaaatagatttttgctgataatatttttccaacatagaaaaaagttgtggataagcgcgtggtatatcaggccctggcgaaatcaatatatgactatatttttccgctgtactttcctttaaatcttccacgtttaaaacatcataaggcacatttaattttcgaattaaatccaccaagttaaaagtaaaagaatcgtgattattaatgatgagtaatttcataacagttcggtattcgttataatcaggtcattttacgcaaaatggcacaaagcacaatgcaacattttattgaacaggctaatcattatggcaaacaacgcacgccatttttctttcttattgattttgaaaaagaaaaacccttgatttgtcctctcgaaaattctgcacaacaaggcatttattttgatattttaggcaaaagaaattgcacgatttctccacaatctctccctcttaatttcaccaaacatccaatgcctttctcgcattatcaacaaggttttgaacttgttcaaagtgaattacaaaaaggtaattcttatttattaaatctcacctaccccactgaaatttcaggtaatctgtcacttgaacaaatttttcatcaaaccaatgcaccttataaattgtggttacaagatcaattcgtttgcttttcgcctgaatgttttgtcaatattcatgacaacaatatttttacctatcccatgaaagggacaattaatgccactctgcccgatgcagaaaatcagttactcacaaatgaaaaagaacaacgcgagcattacacgattgttgatttaatgcgtaatgatttatnccatggtggcagnnaacaccatgggtaccgaaggcccgatattcgtataccat

SEQ ID NO: 323 - DNA, 2965 bp, H. influenzae
caagatggctaccacaatattgtcggcatataaacggccgcgcaaacccactctaaaaatcaccacatctaatttgcttgcttaaataaatgcaatgcagaaagggtgctaaattcaaaataagtcagcgattctgtttgttttcatcaataaaagcaaaagaggcggtatgtgcttcatcgggtaaatcttgattttgaatgcgtactcgctcgttataacgcaataaatggggcgaagaatacacgcctacacgtaatccgtgattaagcagaatcgtttctaacaagcgacaagtcgtgcctttaccattcgtcccccccacagttatcacataaggggcgggatgaagtaaatccaatttttctgccacggattgaatacgatctaaaccgagatcaataggtttaaaatggcttttttctaaataagaaagccactcagcgagtggcgaagtggctttaagttgcatattattcatcttctgaaatgagttcaggttctacaaaaggagaaggttgattcgttaatttactcagtacacttgctaaagtttgacgcatttctgaacgtttcacgatcatatcaattgcccctttctcaagtagaaactcactacgttggaaaccttctggcaatttttcacgcacagtttgttcaataacgcgtggccctgcaaaaccaattaaggcttttggctcggcaatatttaaatcccctaacatcgcaaaactggctgatacgccgcctaaagtcggatccgttaatactgaaataaatggcacacccttttcacgcatttgagcaagtacggcactggtttttgccatttgcattaaagagaataatgcttcctgcatacgagcaccaccactcgcagagaaacatacaaacggacaattcatttccatcgctttttcagccgctttaacaaattttgcaccaactacagaacccattgaaccgcccataaaagcaaagttcgatgcagccacaacgattggcatattataaagtgtacctgtcatagtaattagcgcatctttctcgcccgtttctttttgcgccgcattgatacgatctttatatttctttaaatctttgaattttaaaatatctttctggttctaaatctgccgcaatttcttggcttgaatcttcgtccaataaatttaataaacgctcacgagcatcaatacgcatatgatgaccacatttcgggcaaacatacagattacgtttgagttcttcactataaagtacttgttcacaagcagtacattttgtccacacgccttctggcacattggcttttcgagtggaagaagaaggacttttactaaaaattcggttaatccagctcattttttgacctttttattgactagaaaattgcgcgtattagaacataaatttatagaatttgctacttgtaagaccgtttttgtactgctccgatttccttttaaacaagataatttgctctcctcttattgaacattttttttatttttttgtcttacagaccacgttatctgaaatttattttggagtatttatgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccggcattacaagatgggcgtgaatttaaagcaaaatagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaattctatttattagtgcaataatctgcttgatatattaaga

SEQ ID NO: 324 - DNA, 3520 bp, H. influenzae
  misc_feature (2522)..(2522): n = a, c, g, or t
  misc_feature (2598)..(2598): n = a, c, g, or t
ctttattaagccaaaaggtaaaaaatgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaagtaaagcgtaatttcatgttttaaataaccatatctgaaaatattcttcataaaaaaagaccgcactttaaaagtgcggtcaatcttaagtgagttttatattaattttgatattccataattcactaaaaatccaccaaccattagccataaataaattagtgttcctaaaacaagtggttttaatcctgcctttttgattgcgcttgcttgtgtcgttaagccaagggcagccatcgctgaaattaataagaaagaatcgatttcaactaataatttcacgagttcttttggtaataaatcaaaagaattaaaaatcgcaacgccaataaaaagtacagcaaaccaaggaattgtaattttgtgtgatgtattttctgatactccattactacgtgttaataaccaagaaagcattaataaaaatggtgcgagcatcatcactcggatcattttggaaatgacggcagtattcgccacgataggatcaatattttccccaatcgcatacacttgagccacttcgtgtacactagaaccaacataaataccgaattgatgggcgttaattaaatcttgtgaccacgtgtagaacaaggggtaagtaaaaatagcaagcgtcccgaaaatgaccactacggcaatcgctactgaaactttatgagattctgctttggtaacaggctctgccgccataaccgctgccgcaccacaaatactacatccagccccagtgagataaaccaattgtttatccatttttagataacgaatgcccaaaagtgcggtaagaaaaaaggttgaaattagcataatcgcatcagtgacaacagcatttaagccaacatcggcaatatcgccaaaagtaaggcgaaaaccatacagcacaatgccagtgcgaagaagcgtgcctttcgcaaataacacgcctttttccacttgtgttgaaaattgcggataaatggtattgccgattgccattcccagcaagatggcaataattagagcactgatatgataatgatgggaaaaatcagtgtttcctaaatagtgagcaagtatagcgataatcgcaataaatataagtccgaaataaaagggacgagtgttcatttttcctttccttagtgagtgtttttgtcttttacccaagcggtttcatctaaaattttgccaaaatagctttcgactaagcgacgagtaacatcagtttgtggatcagtaaaaagattttgagggctgccatattcaatcatttttccgtcatccattacgataatcgtatctgcaatatgtttaattacaccgagatcctgtcccacataaatataagatatacctaaacgttgttgtaaatcaagggttaaattaagcaattgaatacgtacagaagcatctaaattgccaattgcatcatctattataataatttctggtgctaaaattaatgcgcgtgctagggcaacccgctgcttttggctgatagagagatgcttaatattgagatttgtgtaatcaggataaagtccaacaagagagagggtctcaaagattttttcattacgttgtgtttctgtccaatctgtcgctaggcttaatggttcgtctaatatttgtccaatatttaaacgtggattaaatgcagagttggcatcttggaaaaccatacgaatatgtttagctctagattgngcatcctgatattgtaattctcgatcattaaataaaattcgacccagagttggcggaataatgcccgctatcattntcactagaggtgatttaccagagccattattgccaatgattgcaagtgtttgtttactgttcaagggtaaaactcactttatccactgcattgaattgatttcgaccaaataaactggcgtgacctttaaaagttttagttaaatcttccacttgtaataagggcattattcatttcctttgcaattaagtataaaaggggtggcggttgttttttctttgaaatttttttctcggagattaataggataatgacaagaaaattcgtgttgttttattttcaatcgtcttggtttttccatacattttttttgcgcaaaagggcatcttggaccaagactatctgccttcggtatttgctctataacattccctgtaccttcctccgttccctttttatcttaaatttcatatctttttttcttttctatttctctttttttttatttttttacagcgttccctcttgattcaccgccccttatccttccagcatgcccggcttgtattttcatttgccccttatcccggtcttttctgcctgttttttccttctgttttttcttccccctcttttctcccctctctccggcctcctcgttcttttcgcttttttcccttgcccatcttttttttcttatctttccacatccctttgtatattgttatcttctctctattctttcccccgttattctcccgttttctttcctcccctccctccctttcttattgttttttttcttttttgtcattttcttttatttctctcttttcactccgttatctttttattttttatatttctcttttttttttttgatttcttcttcttttttgtgtctattcttatttttctttttattctttcttctatccttggagtgtttcttattgttacattttttgtttcttcctctttt

SEQ ID NO: 325 - DNA, 1073 bp, H. influenzae
gccctgactttgcatgcctgcaggttcgacttttagaggaatccccctgcgataagaaaagaacttttctttttcgttgaatgtacagtgatttccaccataaatttgcgtaatacctagattgtttaatcgctgagttgcaatttgataaagattactcaagtatttaccttcttcgattgcatcaggttgaaaggcgagtttggctttttcatctactgcaacaaacttttctacaacatcaatcccaacttgaaaggcctttggacctattgcagggccaaaccacgcaataatatcttcaggtttagcttgaaaatatttcactgtttcttctagtacgccatcgcataaaccacgccagccagcatgtgttgcagccacttcattgccagatgttgtagtgaatagaactggcaaacagtctgcagtcataacaacgcaaacttgattgggaacatttgtataaactgcatccgcttcaagattttgtcctgaataaggtaattgaagtactcgagtgctgtgtgtttgcgttaaaaatataggtttttgtggcaagccaaatttttcgactaataaagtgcggttagtttttaccgcacttttatcatcaccgacatgatcgcctaagttgaaactcaaataaggcgctaagctcacgcccccttcacgagtagtggtaaaggcatgaatattctttggaacattccaatttgggttaattgcttgcatattaataatctaactcatcttgatgtttgagatagtcggctttgagtgcattaagcaattcaacaaagtcatctggtaatggtgcataccattccataatttcccctgtgattggatgagctaagcgtaacatgaccgcatgtaaagcttggcgtttgaaattacgcaatacttccataaagtcttcactcgcatttttgggtggacgagggcgtccgccataggtttgatcgcctagcaatggatgggcaatatgtgccatatgaacgcggatttgatgcgtgcgccccgttctaaacgtaaacgtaaacggggtaccgagtccgaatcgtatacca

SEQ ID NO: 326 - DNA, 2322 bp, H. influenzae
  misc_feature (2286)..(2286): n = a, c, g, or t
  misc_feature (2300)..(2300): n = a, c, g, or t
acaggtagagccgtaaaacataatcttctgaaagttgaatgttggaatccaagaaattttacattcgacaagcataaaactgtggacgatcgcccttatggtggtggcccaggaatgctgatgatggtgcaacctttacgggatgcgattcatactgcaaaagcagcggcaggagaaggcgcaaaggtgatttacctttcgccacaaggacgtaaacttgatcaagacggcgtaaccgagcttgctcaaaatcagaaattgattttagtatgtggacgttacgaagggattgatgaacggttgattcaaactgaaattgatgaagaatggtcaatcggcgattacgttctaactggtggggaattgccggcaatgacattaattgatgctgttgcacgttttattcctggtgtattaggcaaacaagcctccgcagaagaagattcttttgcagatggtttattagattgcccgcattacaccagaccggaagtgttagaaggattaactgtaccacccgtgctgatgtcgggacatcacgaagaaattcggaaatggcgattaaaacaatcgctacagagaacgtggttccgacgccctgagctcttagaaggcctagctctgactgacgaacaacgtaagctgttaaaagaggcgcaagccgagcataacagttagtttcagttacatctaggatcaataaaggatcaaacaatgtctaacattatcaaacaacttgaacaagaacaattaaaacaaaacgtacctagcttccgcccaggtgatactttagaagttaaagtatgggtagttgaaggtagcaaacgtcgtttgcaagcattcgaaggcgtggttattgcaattcgtaaccgtggcttgcactcagcatttactttgcgtaaagtatctaacggcgtaggcgttgagcgtgtattccaaactcactctccagctgtagattctatcgcagttaaacgtaaaggtgcggtacgtaaagctaaactttactacttacgtgaacgttcaggtaaatcagctcgtattaaagagcgtttaggcgcataattccattatatttaatgataatctaaaaaaccttgggatattccaaggttttttgctatgtggatcatggtaatttaattaatcattaggatgatcgattaaaattccttattttacttcaacaacgatatcggattctgatttaggtttcaatttacccacttcatataaatcaatgccagtatctttggctatttcaattatagtttgaacgctattaggctcaacagccactaataaaccacctgatgtttgaggatcgcacaaaatcgctttttgttcttccgttaatgcgccaactttatgtccataactttcaaaattacgccctgttccaccgggtacgcaaccttgagcaatataatcttttactccgtccaaggttttaattttgtccgaaaaaactaccgcacttagatttgaaccttcacagatttcaattaaatggccaagtaaaccaaatccagtgacatccgtcattgctgtgacgccatccacttgggaaaattgactgccaatagaattcatttggcacatagcggcagtggctaaaccttgatgttctggcttaagttttccttttttctccgccgtcgtcaaaataccaataccaagcggttttgtcatataaagcttacaacctgattttgcagaagcattacgttttactttttcagtgtcaatcacacctgtcacggctaaaccaaaaataggttcaggcgaatcaatggaatgtccacccgccaaagcaatacccgcttgatggcaagcaaaacgaccaccatcaacaattttctgtgcaacttctgcaggtaatacattggttggaaaacctaaaatagcgattcccataatcggcttaccgcccatagcaaaaatgtcactaatggcattggtcgcggcaattcgtccaaaatcaaaaggatcatctacaatcggcataaaaaagtctgtggtactgataattgcagttccattaccaagatcatacaccgccgcatcgtctgcagtttcattgccaacgagcaaatttggatcataaaatttttccagttctgaatgtaaaattgtccctaacaccttaagcgaaattttacagcctcaacctgcaccatggctgtattgcgtcagcccgaatttttcttccatttcttatttaccttattgaatatcccgtttcgagaaatgactttcaaccctattttttatcgtaagaagctnaacatctttcctgnacggcatatttgcaaatccaaa

SEQ ID NO: 327 - DNA, 2078 bp, H. influenzae
tgtttacgattcggctcggtccctaccacggttgcggcctttgtgaactttacggaattttgtacgttttggttgcaacatttagcgtttctccttacttacgacctttaccgcgaggagcctttttaggcttgtcggcaggttgttgttctgattgcgcaacggcagccattccaccaagaatttcacctttgaagatccacactttaacgccgattacgccgtaagttgtatgagcttctgcagtgttataatcgatgtccgcacgaagagtatgtagaggtacgcgaccttcacgataccattctgaacgtgcgatttctgcaccacctaaacgaccgctaacctcaactttgatacctttagcacctaaacgcatagcactttgtaccgcacgtttcattgcacgacggaacattacacgacgttctaattgagaagcgatgctatctgcaactaatttcgcatctaattcaggttttttcacttcagcaatgttaatttgagcaggaacgccagcgattttagacactgcgttacgtaatttttcaacatcttcgccttttttaccgattacgataccaggacgagctgtgtgaatagttacacgaatacttttagctggacgctcaatagtaatacgtgaaactgaagcatttgctaattctttatttaagaatttgcgtactttgaaatcgccttcaagattgtcagcgaagtcttgtgtattcgcgaaccaagtagagctccaaggtttaacaatacctaggcgaataccatgtggatgtactttttgacccattgctattcctctacttattaacgatctgacacaaccacagtaatgtggctagtacgttttaaaatacgatctgcacgacctttagcacgtggcataacacgtttcatgctaggaccttcatcaacgaagattttagcaactttaagatcatcaatatctgcaccgtcattgtgctctgcatttgcaatagctgattctaaaactttcttcactaaagctgctgcttttttgttagtgaaagttaaaatttctaatgcttgcgcaacttttttaccacgaattaaatcggcaactaagcgagctttttgggcagaagtgcgagcgtaacgatgttttgcgatagtttccatctctttacctcttatttcttagctttcttatctgccgcgtgaccgcggtatgtacgagtcggtgcaaattcaccaagcttatgaccgatcatttcatcagatacataaacaggaacgtgctgacgaccattatggactgcgatggtcaatccgatcattgatggaatgatcattgaacgacgggaccaagttttaattggttttttatccccgctttccaccgccttctctaccttcttcaacaagtgtaggtcaaggaaaggacccttcttgagagaacgtggcatggctaatcctctttaatttaatctattatttgccacgacgacgtacgatatatttatcagtacgtttgttgtgacgagttttcttacctttagtttgaacgccccaaggagttactgggtgtttaccaaagttacgaccttcaccaccaccgtgtgggtgatctactgggttcattgcagtaccacgaactgtagggcgaatgcctctccagcggttagcaccagctttacccaatacgcgaagcatatgttctgagttaccaacttcaccgattgtagcaacacattcagctaatactttacgcatttcgccagaacgtaaacgtaaagttacatagttgccttcacgtgcgatgatttgtacataagcaccagcagaacgagcgatttgaccgcctttacctggttttaattcaacgttatgtactgttgaaccaactgggatattacgcattggtaatgagttacccactttaattggtgagtttatgccagcttggatttgatcgcctactgacaaacctttaggtgctaaaatataacggcgttcaccatctttataaagcactaaagcaatgttagcagaacggtttggatcatattctaaacgctcaacaaccgctggaatgtctaacttgt

SEQ ID NO: 328 - DNA, 3454 bp, H. influenzae
  misc_feature (663)..(663): n = a, c, g, or t
  misc_feature (701)..(701): n = a, c, g, or t
taagttgtttgccgccgtaaagggcattaactaatgcgcgagttccagtaatcgcggtaaacatagaaatcgcaacaccaagtgaaagcgtaatcgcaaaaccttgaattgggcctgttcctaccgcgtatagaataattgcggttaagattgtggttaagttagcatcaaaaatagaagtaaatgcaccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcaccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgtgcacctaatgatgggccaattgtgcgttcttcaacaatttgaattggtgcaattaatgcgccagatttcaacaaggtagaaagattatgtgcttcggcaatactatcaacaccagtaatttggaaattagaaccaaaacgacctgaattgtgcaacattaataacttctttnctgcttttctaaaatggttttgccattttcatcttttntgccattatctttatattcaacataaagcgttgccattggttttttgtaatattttttagtggtctgagacataatctcgccaccttcgctatccaaggttacactcacttgcggcgtgcttgaatgctgatctaaaccagagcttgaattaatgatatgctccccacctaatacggcacgtttaaataatgcaacaggatgcccttggcgatcatatttaacttccgaatcagctggtaacatattacgagaaatagcatcagctgtaacattttgatttacgatacgaaactcaagtgttgccgttgcccctaaaatttcttttgcgcgtgcagtgtcttgaacacctggtaattcaatcacaatacgttcagcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatgtctaatgttggatgtaattggcgaataattcgctcagctttagcacgctggctcacattagctaaggttatcaacgtaccaaaatgctctgtatttttaatggcagtatattgaattttttctttgcgaagttcgccacgcaaactgtcttgtaattgctcttggcgttttacaagtgcggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgcgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaacgttactcttaaagtgattttaatgaacctttaggaagaacgctcacaatgtagttacgattaatcgtaatttctgtcgtgtcgtttaacgcaatcacgatgctatcactaccttcggttactttagtaattttgcctattaaaccaccagcagttaaaacttcagtaccttttgcaagctcagacatcaattttttgtgttctttattgcgtttagcttgcgggcgataaatcataaagtagaaaattaaaccaaagatcacgaaaataaatagcgtggacattggactttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgactaaagcaacagaattttcttcggcaaaaatagaaaaattttccaccgcactttcaaggtttaagatcaacattagctcatcatttttattcaaattttttaaggcttttttggcacttaaaagaggaatggggcatcgaagtgcggttaaattgagctgatatttcattctttaacttgacgacgagcactcatgcgcttgcccatttcagtcaaaatatccgcacttaagcattcacgccccatttcaaataacggctcttctaacgcaatatgacgatcataaccttgaataaagcgttcaattaaatattcatcaatattttgacgttgttcagaaataagctcttctaactgcacagataatgcattccaattttcatgcaaatattcgtgctgtttttctaattcatcaatggaagtttgtgcttgcggagccactttgactaattgagggaaaaaatctgattcttcatcatcgtgatgtaacggtgcggcacgattgaaataagttaaaatttgctcaacatcatttaacacagcctgagtatagccgtgtttttctagataatcaggcaaaatgcttaactgacgacaaaaacgttttactttactatgacaagcataaagcatttcaataggttcattccatgtggcgaattgttgaggttcaagaatttgcataaggtttcctttgttaaaaagtgcggtcaaaaaacgcttcatttttctaccgcactttcatcaattatgagttatccgctaattgtaatggtggaacaggtttgcccatgcgagcatagaattccaccacaaaatcatcaaaacgatcatcttcaatcgcttgacgaatttccgccattaaacgttgataatagcgtaaattgtgaatggtatttaagcgtgcacctaaaatttcaccgcatttatctaaatgatataaatacgctttggtgtagtttttacaggtgtagcaatcacattcaggatctaacgggctggtatcatcacgatattttgcatacggattttgacaatgccgtctgtcacaaataaaggggtctcatagagtcaactgcgaggcatgcaagtcaaggc

SEQ ID NO: 329 - DNA, 2455 bp, H. influenzae
  misc_feature (2421)..(2421): n = a, c, g, or t
ctgtatacgatatcggctcggtaccctacgtgttttcaccgtgcaacgtaatgactctcgaattggttcgcgatcaacccaatgtaattggctagcaatcaatccttttgaaaataaacgaggatgatcgtgaccttgcgcgacaataagttcattattttctacatctttatctactacataccaagcttcatctcccgcattttttagaccaccaatgcccaatcctttgcgttgtcccaatgtgtgatacattaatccatcatgacgaccaataatttcatcatctacagtgcgaatattacctggttgagctggtaaatagcgtgctaagaaatccttaaatttacgctcaccaataaaacaaataccggtagaatcttttttcttcgccgtaattaagccaagatcttcagcaatagcgcgaacaatgggcttctcgatttcaccaacggggaataaactttgccccacttgtttatggcttaaagtataaagaaaataactttgatctttattggcatctaaaccacgtaatagttttgcattttcattatctcccgctctacgtacataatgccctgttgcaatataatctgcaccgagatcttcagctgcatattctaaaaatgctttaaatttaatttctttattacatagaatatctgggttcggcgtgcgtcctgctttatattcagttaaaaaatgctcaaagacattatcccaatattctgccgcaaaattaattttatgtagtttgatccctaatttatcgcatactgcttgagcatctgcaagatcagctgcggcagtacaataatcagagtcgtcatcttcttcccagtttttcataaacaggccttccacttgatagccttgctgttgaagaataaaagctgacacagaagaatccacgccaccagacataccacaaatcactttttttgtcgcatttctcgcaagctgttcttgcgtcagttgaggaaagtgttgattataagtatttgaaattaacatagttctcccgtaacttcggttaaggcgaagcacattggtcattgaattagaaaacggcaaaataattttgccgttaattttattttgcacataaagtgcggtcagttttgagcaagttatttcacttcataaaattgcgagttatcatcttttttcgcaaatttttgctcatattcagcttttgcttgttcatcgcctgcatctaattttgattgaagcgtgtcgcaaggtttatcacaatcacaagctttgtcaataccaaggctagataaaccaccgcagctgccttttaaactttgttttttgataataaagccgatagacatcaacaatataattgcgacgaaagcgattaaagtaaaaaataaagtttgcataactattcttttgtttctgttaattttttgaaagcagaggatgatttggtaacaaaaccattatctgttctaatgattaaataaacggcaagattatttttctcagccacttctaacgccttgtcttcccccagcacaaataaccctgtagataagccatctgcagtcattgaggttggtgcaagtcccgtaattgaggctaaatgatgctgaatgggataccctgtttcggatcaatttcatgagcaaagcgtttgccattttcttcaaagtaaatacggtaatcgccagaacttgccattcccatattgttaatccaatgacagcttcagccgctctttcgcctgttgtagttggtttttcaatggcaatctgccaaggtttaccttcaatattttttcctttcgcacgaatttcaccgccgatttcaaccatgtaattctgagcatttagttgttctaacttttcagccacctgatcaacgccaaaacctttagcaattgacgataaatctacgtaaacttgaggaagtgctttgcttaatgtcggttttgcaccactcatatcaagggcaattttatcaatgccaacccaggcttggcgttcagctaattgttctggtgtaggttgtttttcggggcgtttttcaggaccaaatccccataaatttacaactggaccaacagttacatccaacgcgccttcggtcactttatttaaacgaatcgcttcagctaatactttggcaaaatctgctgaaatctcaatcggtgtgttcacttgggtattttgattgaagcggctcaattccgaatcttttttgtaagtggacattttcgcattcacatcttttaagattgcttcaatttcttcatgcgtcttttcagatgttgcttttattgaaccatcatcaaggtatttaacatgataagttgtccccattgttttaccgcttaaagagataactttgttcttttgacaagcagcaagacttaatgccattgctaccgctatgatggggatcccntaagagtcgacctgcaggccagccaaggcatggc

SEQ ID NO: 330 - DNA, 2983 bp, H. influenzae
  misc_feature (2816)..(2816): n = a, c, g, or t
ggatctcggaataggttttaacgggaaccttttagctttgccccgttttcatatgacccacgggggtaattttccccgagttttgttttctgctacggatttgttctttacgggatgctctaaatccgtgattctgctttacgaagtgagtaacgtgtgaattattacccagtttcgatgtaagttagcacctgaaattttgttgatacgacttaattcaacttcttcaatttcgccaaatttactgaaatcaacttttggccatggcaataagcctaatccagcaccatttgctacaccattgccagtagcttgtgctgttgcaccgctttcataagctttaactgcggtcttcacataagcttcaatatcttctttaacgatacgacctttacgaccagtaccttttactttatctagatttacaccaaattcacgagctaaacgacgaataactggtgttgcgtgtgcatatcctgtacttgcttctacttgttcttggcttaatccagatacgttgttatttgattgagctgcttgtgcagtagtatcaggagctgctgcctgtggtgcttgtgcagtagtagcaggagctgctgcctgtggtgcttgtgcagtagtagcaggagctgctgtctgtggtgctgatgttgaagctgatgctgatgctgctggagctgcacctagtacttcaaaacgcataattaatgaaccagttgaaactttatcgcctgatttcactaaaatttcttttaccacaccgccgaatggtgcaggaacttccattgaggctttatcgccttcaacgctaattaaagattgttcttcagtgattgtatcgccaactgcaaccataatttcggttacattgacttcatcgccaccaatatctggcacatttacttctacaatagctgaagccgttggtgcggtagcaaccactggtgcagtaggcgcatcagctactggagcagtaggctcatcagctgctggagcagcacctgccgcttctaatacaagcattggagtaccagttgaaactttatcgcccactttcactaaaatttcttttacaacacccgcttctggtgcaggcacttccattgaagctttatcgccttcaacgttaaatgatagattgatcaacagaaatggtatcgcctacgtttaccatcacttctgttacggtaacttcatcactaccaatatcaggaatttgaatttgttttgacattttttgttccttttaaagtgcggtcataaaacacaatgttttttgaccgcagttttcatcaattacgcataaagcggattgatacgatctacattcaaaccgaatttcgcaatcgcatctgcaaccacttggttagatactgtaccttctttcgctaattgagaaagtgcagcaaccacaacataacgtgcatcaacttcgaagtgttcacgtaagtttgcacggctatctgaacgaccgaaaccgtctgtacctaatacatgatagtgcttacttggtacaaatgcacggatttgatcagcataacctttcacatagtcagttgaagcaacggttggtaaatcagctaatacttgagcaacgtatggtacgcgttgtgtctctgttgggtgtaataagttccaacgtgctgcatcatgaccttcgcgtgctaattcattgaatgaaggcgcagaaaatacatctgaagtcacaccgtagtcatttgcaagaatttgtgccgcttcacgaacgtgacgcataatcgcaccagaacctaataattgaacgtgacctttgccttttttaccttccactgtttcaaatttatataaacctttacggataccttcttccgcaccagcaggcattgcaggttgatccatcacttcatttaatgtagtcatataatagaatacatcttcttgtttttcgccgtacatacggttgataccgtcttgcataataacagcaacttcaaatgcaaatgatggatcgtaagtaacgcaattaggaataacgcccgcttgaatatggctgtgaccgtcttcgtgttgtaaaccttcgccatttaaggttgtacgaccagaagtaccccctaccataaagccacgagctaattggtcgcctgcagcccacatcatatcgcccacacgttggaaaccgaacattgagtaatagataaagaatggaatcatcggttggttattgacagagtacgagttcgctgctgctaaccaagatgcggttgcacctaattcattgataccttcttgtaatacttgaccatcttttgcttcacgatagtaagccactaaatcacggtctgaaggtacatagttttgaccatgtgggttataaataccaacttgacggaataaaccttccataccgaaagtacgtgcttcatccgcaatcattggaacgatagttttaccgatgtttttatcttttaataagatgtttaatgcacgagtaaacgccatagtggttgaaataccacgaggttgttcttctaataatgctttaaactcttctaatgcaggaactttatattcaacatcaaatttagtacgacgagcgggaacataaccgtttaatgctttacggtgaccatgtaagtattcatactcaggtgtgccttcagcaaatttaatgtattctaatttttctacttgttcatcggttaatggtaattcaaagaagtcacggaaacctttaaggctttcgtaagacatttttttagattggtgagcggtatttttactttccgcttcaggaattttataacctttaacttgatgcgctaaaatcacaactgggnttcggtgcattttgtgcttttgcataggctgcatataatttttcgctatcatgtgcaccacggcgtaatgcccagatttctcatcgggcatatcagcaactaatggcgcaagttcttggatacgacccaagaaatgtttcgcgatatatgccccatcctttaattaa

SEQ ID NO: 331 - DNA, 2726 bp, H. influenzae
gataaaagagggggaaaaaagaaatacgggaagtggaggggtgaaaagagggagagaaagcagtaaaagaagaggaagaagaagaagagggtaataagaaagaaagaccgagaggtgtgggagagccgggtgttaaaggcgaacaagaatggccaaattaggagtaggacccggacaaacaataagagcaagttgttttaaacataagatccattctgataaccgtttttcatgggtaattttaaatgaagaatggtttctcggaaccgaccattcaacaaccatttgccaatcaataccgaaatagggttgggttggtccaccaatatcgcagactaaccaatccccttttttccttttgggggctgaaatttaaaaccgtcttccgcgcaatgttcaatgcaccccgtatcatgcaaactcgccgccatttttccgtgatcaactgcataaacaaataaacctcgtttgactaattgatacgtccaaccgccagggcaagcccctaaatcaacgccaatcatattttcatttaaacgtttattctcttctttacgcggaataaaagtcaaaatagcttcttctagttttaacgtagatcgactcggcgcatctgcaggaaattttaaacgagggattcccataaaatgggaggaatgattatccacataagaatatcccacatagcagcaattcggttttacaaaaaaacaatgtaaaaattgaccgcacttttgactcgcctttgccgaaagccaaccttgttttttcaatgcctgacgtaaaggcacggtaaacttacgacaaaaagtggaaagctcctttgcttcatttgtgtctgcagtttctacaaaaagctcgctagattgagcaaaattaacttgttgtgataatttcttcaaatgccgccacgatgggacttaatacgatcagcgggatctaaatcttccaagaaatcggaaataaccattcatctgacgagcaaaaatcaaacgattaaaaggaatgtatcgggcaaggcgatctgcctcatcaggttgataacattcaaaaatcacgtagcccgaattatcttgcactcgagcaaaacccaaatacacctaaatgacttgcttgatcggtaatctctgcggcgacttctttctcaaaacctgggcgacaatataatgcgagtttattcattttcttcttgtttaattgagttaataatccactgacggaatgcttgaattttttggtcatcaaggcgatcaagatgattgaccacataaaatgattttggatcaggcaaattagtcggcaacactgcttgcaatgagccattttcaatttcttgcaaggctaataagcgattagctaatacaataccttgcccgtgaatagccgcctgtaacgccataaatgtatggctaaataacggcccttgctgaatatttaaatcatctaactgtaaatgatttgccatcgcttgccaattatcacaggtatgaatgtgaattaatgtgtgtttttttaaatcttcaggctgaataattggattttctgctagcaattcaggtgaggctaaaatcaataaattttcttcgcaaagacgatctacttgaagattctgccaatttcccaaaccataataaatagcaagatcaatttctttatttaacaaaccttcatcttgatccacgcctgttaaacgaacctcaatttgcggataaagctgattaaattcacttaaatgtggcactaaccattggataccaaaagtttgtggcacgctaatatttaaatgcggatccgtttttaacgttaataatcgctctgttgcttcatttaagcgacgcagaattttattaatatcaacaaaataagctttaccaagctccgttaattctaaagaacgattctttcgcttaaataattcaatccctaaaaattcttctaataatttaatttgatgactaaccgccgcctgtgtaacacaaagctcatctgctgctttagtaaaacttaaataacgagcagccgactcaaaagattttagtgaattcaatggtggcaaacgtttatacatatagtatttccatttataaaattttcgtctataatggacaagatttatttcaaattagtttttctaatacctaaaataaaaaaacgtcacttgtcctttcctacccttttccttacaatacaaccatacttaatgattggtaatttcttactagttaatgagtttcagacttaagtatgatgttgtgtttgcatatagttcgggaaaccgaacttgagtaacaatttgttactcatttacttcctgtatattattaaaccgatttggttaaacgctgctctcattgagtggcgtttttttcatcccgattttagcataactatattgttatttcctgccctgtttccaaaatttcattattcctttttagttggctaaaaattgcatcatttcgagaatttattatttaaatcacttcaggaatggtgtagattaagcgaaatttcattcaaaaaataatattaaggaagtaaaatgaaagacttagactggaataaccttggttttagttatattaaaacagattaccgcttcatcgctcactggaaagatggcaaatgggacgaaggaaaactcccccagacatactttactatcacgaagttctaccgccttactcggccacatgctttgaagcttaaagctaccgtgcagatgc

SEQ ID NO: 332 - DNA, 3687 bp, H. influenzae
  misc_feature (1427)..(1427): n = a, c, g, or t
  misc_feature (3656)..(3656): n = a, c, g, or t
  misc_feature (3659)..(3659): n = a, c, g, or t
tgcagcgggcgcggacgacgaagaaacacctggtgcgccggacgggacaaacaagcggcaggaataggcgcgagaaagaacttaccacggagggagcgattggcaaaaagacgaacggaaaatagtagatgggggaagaagccaaagggacggtagtaataaaaaattggcgcgagaaaggggatgcgaggatgaaggtgaaaaaggtagaccaccgatgggtggcaaaaaagatagggtcgattggaacaaggctttacccaagtaggtatgccacacaggtgcaacgccataggaacgatagcgtaaaaagattattgtgtaaataaagctctaagatttcttgtgggtgagggtattttcaatttctgccgcaagcaccgcttcacgggctttacgaataatggttttttctggggttaagaaaaagttacgcgctaattgttgagtaatcgtacttgcaccttgtgatgcaccgccattactcactgcgacaaacaatgcacgagcaatgccgatagggtctaatccgtgatgatcgtaaaaacgattgtcttccgttgctaaaaatgcgtcaattaagcgttgtggcacatcggctaatttcactggaatacggcgttgctcgcccacttcgccaattaatttaccgtcagccgtataaatctgcattggttgttgtaattcaacggttcttaatgtttctactgagggcaattccgattttaggtggaaatacaacattccgccagccactaaacctaaaatacataaagttaatagggtgtttaatattaattttgcgatccgcatcgtaaaattctcgcttggttaatgaatattcttgtcaagagacctatgatttagttgttaagtataaaagattcagcctttaaagaataggaaagaatatgcaattctccctgaaaaattaccgcactttacaaatcggcattcatcgtaagcagggttattttgattttgtgtggtttgatgatcttgaacagccacaaagttatcaaatttttgttaatgatcgtgattttaaaaatcgttttttacaacagctaaaaacacaatatcaagggaaaacctttcctttacagtttgtggcaagcattcccgctcacttaacttggtcgaaagtattaatgttgccacaagtgttaaatgcgcaagaatgtcatcaacaatgtaaatttgtgattgaaaaagagctgcctatttctttaaatgaattatggtttgattatcgttctacctcgttaaagcaaggttttcgattagacgtttctgcaattcgtaaaagtactgctcaaacttatttgcaagattttcagccatttaaaattaatgtattggatgttgcgtcaaatgctatttgggtgcatttcagtattttgtgaaatgaacaagtgcggtcaganaataccttatttttatttcaagaagatgactattgtttggcgatctgtgaaagatcgcagcaatcgcaaattttacaatctcacgaaaatttgaccgcactttatgaacaatttaccgaacgttttgaaggacaacttgaacaagtttttgtttatcaaattccctcaagtcatacaccattacccgaaactgtttcgagtagaaacagaactcccttttattgcgcttggcaacgcgctatggcaaaaagatttacatcaacaaaaagtgggtggttaaatgtcgatgaatttattgccttggcgtacttatcaacatcaaaagcgtttacgtcgtttagctttttatatcgctttatttatcttgcttgctattaatttaatgttggcttttagcaatttgattgaacaacagaaacaaaatttgcaagcgcagcaaacatcttttgaacaacttaatcagcaacttcacaaaactaccatgcaaattgatcagttacgcagtgcggtgaaagttggtgaagttttgacatctattcccaacgagcaagtaaaaaagagtttacaacagctaagtgaattaccttttcaacaaggagaactgaataaatttaaacaagatgccaataacttaagtttggaaggtaacgcgcaagatcaaacagaatttgaactgattcatcaatttttaaagaaacattttcccaatgtgaaattaagtcaggttcaacctgaacaagatacattgttttttcactttgatgtggaacaaggggcggaaaaatgaaagctttttttaacgatccttttactccttttggaaaatggctaagtcagcctttttatgtgcacggtttaacctttttattgctattaagtgcggtgatttttcgccccgttttagattatatcgaggggagttcacgtttccatgaaattgaaaatgagttagcggtgaaacgttcagaattgttgcatcaacagaaaattttaacttctttacagcagcagtcggaaagtcgaaaactttctccagaactggctgcacaaattattcctttgaataaacaaattcaacgtttagctgcgcgtaacggtttatctcacatttacgttgggaaatggggcaaaagcctattttgcatttacagcttacaggtcattttgagaaaacgaagacatttttaaccgcacttttggctaattcgtcacagctttcagtgagtcgcttgcagtttatcaaacccgaagacaacccattgcaaaccgagatcatttttcagctagataaggaaacaaaatgttacatttggtttttcctgattatattattttttatgaattgcagttggggacaagatcctttcgataaaacacagcgtaaccgttctcagtttgataacgcacaaacagtaatggagcagacagaaataatttcctcagatgtacctaataatctatgcggagcggatgaaaatcgccaagcggctgaaattcctttgaacgctttaaaattggtgggcgtagtgatttctaaagataaagcctttgccttgttgcaagatcaaggtttgcaaatttacagcgttttagagggcgttgatgtggctcaagagggctatattgtagaaaaaatcaaccaaaacaatgttcaatttatgcgtaagctcggagagcaatgtgatagtagtgaatggaaaaaattaagtttttaaaggaagattatgaagaaatattttttaaagtgcggttattttttagtgtgtttttgtttgccattaatcgtttttgctaatcctaaaacagataacgaatgtttttttattcgtttatcgcaagcacctttagctcaaacactggagcaattagcttttcaacaagatgtgaatttagtgatgggtgagaggttagaaggcaatatttctttgaaattaaacaatattgatatgccacgtttgctaaaaataatcgcaaaaagtaagcatcttactttgaataaagatgatggggtttattatttaaacggcagtcaatctggcaaaggtcaagttgcaggaaatcttacgacaaatgaaccgcacttagtcagccacacggtaaaacttcattttgctaaagcctctgaattaatgaaatccttaacaacaggaagtggatctttgctttcttctgcggggagcattactttgatgatcgcagtaattgctggttatcaggagaaccggggtnctntaagtaaaccgcaggcagcaagaaaggc

SEQ ID NO: 333 - DNA, 2378 bp, H. influenzae
aaaataagttaactcgaaactgggtaagtaaattacggcggaatacataaagagggcgaggtaagaacagtaaaaccctttcatgtgtggggtatctcgcgagtaaaaaaagcgaattcgcgtgccgagttggtttcccaccattcaaagggaaaatggtattatttgagggaggggaaggtccgataatatccacgaagtggtgtgcaaaattaacgtggtctttgtgatccaataagataaatcttacggcccttagcaatattatcaaataaggtgaagcggcgctttaagaaagtatcagccaatttttagcagtttgctcactatttacccgtaatgcaagatgatcgatttcatagtgagacagatctattgtcatttctttggctaaatgctgaatttttctttcaaatgttgctaaatctgctgaaagtgcggtcaaattttcctgtaaatttgtcattttgtccctttgagaaatatacaaagaacggtatcataaccgattatttttattattcaatttgaacataggaaaaaacgtgaatattcaatctattctatccgataaaattaaacaagcaatggttattgcaggtgctgatcaatcttgtgatgcgcttgttcgtcaatcaggcaaaccacaatttggcgattatcaagccaacggtattatggctgcagcaaaaaaattaggtttaaatccacgagaatttgctcaaaaagttttagataatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcctctccaaacgtagcaaaagaaatgcacgtaggtcatttacgctctacgataatcggcgatgctgtagctagaacccttgagtttttaggtcacaatgtcatccgcgctaaccacgtaggcgactggggaacgcaattcggaatgcttattgcttatcttgaaaaaatgcaaaacgaacacgccagtgaaatggaattacaagatcttgaagccttttatcgcgaagccaaaaaacactacgatgaagatgaaatattcgctgaaaaagcacgtaattacgtcgtaaaattacaaagtggagatgaatattgtcgaacgatgtggaaacgtttagtcgatatcactatgcaacaaaatcagcacaactataatcgcttaaacgtgactttaaccgaaaaagatgtaatgggcgaaagtctttataatcctatgttaccaagcatcgtagaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaactgatattgctgcagcaaaatatcgttatgaaacattaaaagctaatcgcgcacttgttttttcagatactcgccaaagccaacatatgcaacaagcttggttaattactcgtaaagcaggttatgtaccagacagtttctcgttagagcataaaaactttgggatgatgcttggtaaagatggcaagccatttaaaactcgtactggtggcacggtaaaattagccgatctattaaatgaagccatcgaacgcgccactgtattaattaatgaaaaaaataccaatttatctaatgatgaaaaacaagctgtgattgaggctattggtattggatcggtaaaatatgcagatctatccaaaaaccgcaccacggattacgtttttgattgggataatatgttaagtttcgaaggtaacactgcaccttatatgcaatatgcctacactcgaattcgttcgatctttaataaaacagatataaattcaaccgcacttttggctgcacctttaactattaaagatgataaagaaagaacgcttgcaatcaagcttctacaatttgaagaagccgtgcaaactgtcggaaaagaaggcacaccacacgtgctttgtgcttatttatatgaacttgctggcatcttctcgtcattctatgaacattgcccaattttaaatgctgaaaatgaatctataaaattaagtcgtttgaaattggcattattaacagaaaaaaccttaaaacagggtttaacgttactcggtattaaaaccgtagaaaaaatgtaatttagataattaaaatccctttctcaggaaagggattttttatacttgtttactgaataaaaaaagtgccccatggggcactaccggaaaggggatttc

SEQ ID NO: 334 - DNA, 1938 bp, H. influenzae
  misc_feature (248)..(248): n = a, c, g, or t
  misc_feature (1829)..(1829): n = a, c, g, or t
cgaaggtcccgtatattcccgaaataaaacctcttatgtagacgataaaaatcaggtagaattgcctagaatgtttaactcaaaaaaaggaaatcttatgttcgttgttatttttgggtcgtcctggctgccctttactgtgtgcgtgcaaaaaacccttgctgaaaaattaaaaggcgaagttgctgattttgactatcgttatgtggatattcatgcagaaggcattactaaagaagatttatcanaatcagttggtaagccagtagaaaccgtaccacaaatctttattgatgaaaaaccaattggtggttgcactgactttgaagcattaatgaaagaacaatttggtatcgttgcttaatttttcttttaatttacaaaaaagccactttcaatcgaaagtggctttttcatagaatcgttttaaccgttataacgtttaaaaattaatgtcgcatttgtaccaccaaaaccaaagctatttgacatgacagtttgtaatcctgcattttctttcgtctcagtaacgatgttgcaaccttcagcggcttcatctaaggtttcgatattaatacttggcgcaataaaatcattatccagcattaacaacgtgtaaattgcttcgtgtgcacccgccgcccctaaagagtgacctgtcattgatttagttgaagaaatcgctgggattttatcgccaaatacatttttgattgcacctaattctttcacgtcaccaactggtgtagatgtaccgtgtacgttgatgtaatcaattggggtatctacagttgccattgcctgtttcatacaacgctctgcaccttcgccacttggtgcaaccatatcgtaaccgtcagaagttgcgccatagccgacaatttccgcgtagatttttgcaccacgagcaagtgcgtgttctaattcttccacaaccacaacagcaccaccacctgcaataacgaaaccgtcacgatttgcgtcataagcacgagatgctttttctggcgtttcattgtatttagttgaaactgcacccattgcatcaaactcagtagcacattcccaagataattcttctgcaccaccagcaaaaacgatatcttgtttgcctaattgaattaattcaaccgcatgaccaatacaatgtgcagaggttgcacaagcagaactcatagaataattcacaccacgaattttataaggtgttgctaaacaagctgaaacacttgatgccatggttttcgttacagcgtaaggaccaatcgcttttacaccgcgagggccacgaaccgcatcacaagccactaattgattatgtgcagagcccgtacctgcaccaatcactaaaccagtacgatcattagaaacttgatcttctgttaagcctgcatcttcaatcgcttcacgcatagaaagataagcataagccgctgcatcacccataaaacggaacactttacgatcaatgtgctcgcttgggtttaatttgattgttccggcaacatggctacgcatattcatttctacaaactcaggcacaacttcaatacctgatttcccttcttttaatgaagccaatacttcttctttgttgttaccgatacttgaaataatcccaaagcctgtaattacagctcttctcattgcttcttccttattggtttatatgtaaaaataacggcacaaaattactacgaaataaaaatatttcaagcaataattcatttgttcgaccagttcagaaaattgcgttattatacgcaaatttcattaggcaagaaaggaataaaatgacctttagcgtgcgacatgctgagattcacttncatcgaaaccatattcccgtttcagatcattcaaaggatgcctatttttttaccgaaagggattacccgaacagaatatggtttctaccagtaatcaactttgggaaga

SEQ ID NO: 335 - DNA, 2314 bp, H. influenzae
  misc_feature (1752)..(1752): n = a, c, g, or t
acgtaaagccggttctttggataatttagcttttttaagtaaagcgcctccggtcccccccaaaatgcgttccaattcgcataattaaaaccttctaaatcgttttcgccaagtcagctcaagcaacatgtcgctggaattctaaacttttcgtagccattttgtccgtgccaaagcattaagtttttagcagtttgtgggaaatagttgatgcccctcggattcctttgttagatttttcgttataccgaattgctcgttggatagcctcaaaatcaaagcctaaatgttcaaaaaaacgctgatcttctgatgaaatcacagctaattgaatgtttggagagatattttctaggctgacccagttatattggatttgatatcgaaaatcgccttgtaaaagattagcgattttttgttgtaccatataagcggaaaatggaataggtacaaagcgaaaaatcagcaacaaagcaaaaacggcgaaaaaaaaacaaaagacaactcgctgccagttttttttccaccatttaggactaaataagtgagaaagtgcggtaaaaattcgcttagtttttttcaatgagatcaagatgttgtttcatccattgcataaaatcaggatccatcgttttaatcatattggaacctcgagtgattgtggcggcacttgtattcagattttgttgaatttcacgctgaggcatatttttatcaatcagctgagagacaatctgcaagcgtaatcctacagcatctcgttcgtctgcagttaataataaggttagaaattcctgtgctttgttttcttcaaaggcgatttttagcatttgaagaaatgcattccattgctctaaattacggctgatatacataattatgctcccatttcacactattaaactagtgcatttagtatagccgattcaattcttcttggctaaagatttgtgggttttctttattttgcaaaatttgatagtaaaaatcataagcgactacattttgcacataaccacgagtttcataaaaaggaatagatgcaacaaattcatctaatgctaattttccactcgcgcgacttaaccatttttctactcgatttgctcctgcattataagcggctgcaatcaatattcgattattaggatattttccattgagttcattcagatgtgcggtacctagcaaaatattattcaatggtttgaataaatcttgttcgccttgataaggtagttgattattctctgctgtcaattttgccgtacttggcaaaagttgcattaagcccctcgcatttgctgaagattgtgccattggattccaagcactttcttgacgagcgattgccatagcaaaagttttgctgatattcaaattctgtaatgcagcattgaagtattcagaataagcatttggcagacgaagagacaggtaaccccacgcttttgctacaatagaagcatcaacagctaattcaaaccattgctgatttttggcatattcagaaagttttagctgagttgtgaaatcaacattatcaagtaaaattcgccagcgttgttttgctaaaccatttcgtccaagttctcttaattctgtaatcattgcaaaaacttgcttaaaaggaagttgttcagcttgagtaaaacttgacgcaatagggacattcagttgatatgcttgttttaattgtgtagccgctaacattggataaaagccacgctcttttgaaagtgcggtcagttntttggtattttttaatatatcttgtttagcttcccaataacgccattcttgcttactttttgattcggcagatagcaaatttagccaagaggttaattcagtttttttgccaaatagccattcgtatacggcgttcggttaaattatcagtctgtaattgtcggatttgttcatcacgccatttttgaaatcagtgtttcattatcaaaaagcgatttaaaaggcgatttccactgtttgatttcatcttctgagagctgcagtatttgccatttttgatagattcaaacttatgttattcatttgttcaggagcgttttaagatacgtggaaagcatcattaatacggttttatctaaagtgttaggatcacttttcttacatttcagcagttgtttagattttcacctgattttggccttttggaacctgtattttcttaacatatctgaagtgctgaggttggtggtcgtatactgggaatagtttgtttaaggtagaatgctgtggcaaaagggtattttttgcatttccctggacttttattggtgggtgtttcttg

SEQ ID NO: 336 - DNA, 3906 bp, H. influenzae
  misc_feature (1106)..(1106): n = a, c, g, or t
  misc_feature (3878)..(3878): n = a, c, g, or t
tgtttccgaattcggactcggtaccctaccttacatccaaagccgctccgcctaaatgccccgtttttaacgcatcaactaaggcaagttcatcaatcaaaggcccacgccctgtattaatcaaaaatgcaccttttttcattttggataaggtttctgtattaattaaatcctttgttgtttccgttaatgggcaatgcaacgtcacaatatccgcttgttttaatacttcatcaaaaggcgtataaccttcacggcaaacagtagcatctttatgttctgcataaagcactttcattcccacggcattagccaaacgccccacttctgttcctaggcaacctttaccaaatacgcccaacgttgaaccgcgcacatctgtaattggataatcaaaataacaaaattgtttgctttccgcccattttgcttccgtttgatcgcgtaaccaacctgccaaactgtgttttaaagaaaaaatcagaccgattacgtgttctggcacggttgtactggaataacctgtcacattacgcacggcgatgcccatttcttctgcagccacaagatcaacattatttgtacctgtcgcagtaatcgcaatcagctttaattttggcagttgttgcaaagtttcacgatcaaaaatcactttgctggtaataacaatgtccgcatccttcgctcgctcaatggtttcggcagaagacgtatgatcatattcagtccaagtatgttcaaaacttgggcgaggaattgaaatatgtttaggaatagccgtgctatctaaaaatacgattttcattaattgctccttttttatatacaaagtgcggtcaaaattaaccgcacttttgatgaaatttaaattgaggtatccaattctggaaaagattttactaaatcatcgatggctttcatttgggaaacaaagccttcaagcgcagaaagtggcaatgcagaagggccatcacattttgcttgatttggatttgggatgtgcttctaagaataaacctgcaatgcctactgctaaacctgaacgcgctaattcggttacttgcgcacgacgaccactcgatgctgccccaaatggatcacggatntgaagtgaatgggttacatcaaaaataacagggctacccttagaggcttttttcattacactaaagccaagcatatccacaattaaattatcgtaaccaaaatttgttccacgatcacaaagaatgattttatcattaccacattcttcgattttttccacgatattgcccatttgacctgggcttaaaaattgtggttttttcacattaatcactgcgcctgtttttgccatcgcttcaacgagatctgtttgacgcgccaaaaaggcgggaagttgaataatatcgacaacatcagcaacgggctgacattgatagatttcgtgtacatcggtaataatttttaccccgaatgtatcttttaattcttggaaaatttttaatccttcttccatgccaggtccacggtaagaatgaatagatgaacgattcgctttgtcaaaagacgctttaaatacataaggcacgccaagtttctctgtcactttcacataagcttcgcacacttgcattgccatatcacggctttccagcacgttcattccgccaaaaagcacaaaaggtttgtcgtttgcaacatcaatattgccaatttttacaattttattttgcataaattttccttaaatcaatggaggggaaaagtatctttattaatctcgcctttaagttctaaaagttgcgtgcggataaacgccgccgttggatcttttggacaatgttccacaaaaaattctaaatctttcaatgctgaaggataagcccccatttgagctaaaactaagccacggtcacggatatgataaggattttcagcatcagtaatcattaaattcttaatatagtgatatgccatatcgttatgctcttcacgaataagcgcatttttcgccagttgctcaaagcgagaataaagtaaagaaagatcggctctatcaagttcttcgggttgaattttcgccccaaacccaaatgcaccttcataaagttgctgcaatttttcttgtgaaatataagtgccatcccaaggatcaataaaagccacttcatctctgacttcagcacgtaaaattaactgtgttgggaaatttactgggtaaattggcaaatccaatgcctcagctaaataaaacaccattgccccaagagtcactggcattccttgacgatgttcaaacacataaggcaaatataaattgcgagcataaaaataatcttctggatcgcaatgaaagccccaatcaccataaaatagctgtagtaactgatgaatctgctcttctttcggccaatctggcgaaatttttttacgcgctttacgcacaagcccacccatttttccccgaagttgtgcttctgagctgccatcatcagagataacaagataaaaatgcacaaatttatcgtataacgcacgtcgataatatttcattacttcttccaaaaacctaaagtgacacgctcattgtcgctataatcacgcacagtttcaaccatttcccaatgattttcttggaaaattgaccgcactttttctccttgttgccatccgtgttcaagcaataatacgccattagaattcaaataactcgatgctaattcaataatatgacgtaaatcagcataccctgcatcattggcaactaatgcagaaaggggttcaaaacgtacatcgccttgatgcaaatgttcatcttgcgcatcaatataagggcggattgctgacgataagatcaaacttccctgttatattatcaaaccaacggctctgcaaaaattctacatttagctgatttctttctgcattagattgagctaatgccacaacatcgggcataagatcaacaccaattatttccagcggaatatgccgcttttggcaaatgggctcaagctcggaagccaaagcgagggcgattgcgcctgtgccagtgccgagatcaagaatacgaaagtgcggtggattttcttccagtttttctaacgcaatttgtaatgctttttccactaaactttccgtgtctggtcttggaatcaatgtgctttttgaaacatttaatggtaacgaccaaaattctttttcaccaagaatataagcgataggttcgccttttagacgacgatctaaaagtgcggtcaattttaaccgcactttttcatcaatctcagtatcatcaaaagcaaggatttgcgtacgcgatttgccagtagcgtgttgaagaagcacaagtgcatcaattttactattttcagtgggatttttttgtgctaaatctacaatcgcttgtgccagccattctttataattcattatttttcgtcttttaacaccatcgtgccagccactaaatccgttaaagaacggcgatcatcacgcacaagtgcaacaataccgctaataatcaataagaaacttgtccatgccaataaaatatcaataatctcacgaccgatgtatttaccaaattcaacaggatgattggtatgataattaaatacgcgcaagcctaaccagcgttttgccattgtttgaccataagttttcatgaaatataactgaaaaccagcatatacaatcatccccactacaccggcaaaatcccccaatgcaaaaccgagaccagccatcacccaaagcacaagcccattaatcatactcgcaagccaacgtttaaaacggcttgcttgagcaggttgagaagatttgaaagcagaagaaaattcagctctttttattttcaatatcttttattcctttaaagtggggtctcntagagtcgactgcaggcagcaatctggc

SEQ ID NO: 337 - DNA, 2177 bp, H. influenzae
  misc_feature (2169)..(2169): n = a, c, g, or t
atccccagcttatcttgcagaacaaaagaaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtagaaatagtaaaaaattgaccgcactttatttaagtgcggtctgtttttatagacttttaaaagaagaaaaaaatgaacttagatttaaatcaacttgttaaatggcgtcgtgaatttcatcgttttccagaaattggctggagtgaattttggacaacttctcgcattgcggattacttggaagacttagattgttttgaaatttttcttggcaaacaaattataaatccagactttgttcgtggacgaaaacaagccgtagtagataaaggcttagctaatgcaaaagcctatggagccaatgaaaaatggctcgaaaaaatggaagggtacactggttgtgtggcattatttgattcaggtaaaccagggaaaactattgcattacgttttgacatagactgtgtgaatgtaacggaaactcgctcaccagagcatattccaaataaagaaggttttgcctcaattaacgatggttttatgcatgcttgtggacatgattcacacattacaataggtttaggtgttgcattatggatcgctcagaacaaagataaactcactggaaaagtaaaaattgtatttcaaccagcagaagaaggtgttcgtggtgcagctgccattgcacaaagtggcataattgatgatgcagattattttgcttcttcacacattagtttttgcgcaaatacaggcactgttattgctaatccaagaaattttctttccactacaaaaattgatattcgctataaaggtaaacctgcgcacgcaggtgctgcgccccatttaggtcgtaatgctttattagctgcagcgcatacagtcactcaacttcatggtattgcacgccatggtgaaggcatgacaagaattaatgtgggtgtgctaaaagcgggtgaaggacgaaatgtcattccatcctctgctgaattacaattagaagtgcggggagaaaataaagcaattaatgaatacatgactgaacaagtcatgcaaatagccaaaggtatctccataagttttgatgtcgcatatgaaactgaaattggaggtgaagcagtggatatgaataacgatggtgaacttataaaactcatcgaagaaatatctcttaaacaaccacaaataaataacggaaattcagattatgctttcaatgcgggggaagatgcgactattttaggtagacgtggacaagaacatgggggcaaagctatttactttattcttgggggcgatcggacaggagggcatcccgaggctgaattcgcacgtggggggaatcaattacttactggggggtaatatttagcctgtgttgcggcgggcgctctttccctactgagcagaactgttgggcctccttcttgcaagaatccgcgcttctgttcagagaaaggggtgtgtggccggcctggtggggggctcgggggggtgcgggggggtgtggtttggctgggagcgcgggcggtggtgtggggtcgctcgccggtnggcggcgg

SEQ ID NO: 338 - DNA, 2702 bp, H. influenzae
tgcggaagaaaatgcgaaaggcattgatttaaaagcatcaacacgtacttataaagataacaatcataaacctgaaatgatgattgctttatctgatttctggttgttgcatggttttaaaaataaatcggatattatagaagcttgcaaaaaaattgcaggaacaagatttacctgatttttatgctgatattatgtaggcagatcaaacgctattgtaccaatggttttccccgattctgttagagaatcaagcagcttatgaggctaacaatcttgatttaattaatccagattattgggtgctttacactattgatgcgatgaatatttctttagataaattagatgcaggtttaatttgtttctatttgtttaatattgtacatctcaaaaaaggcgagggaatttcccaagatgctggcattccacacgcttatttgcgtgggcaaaatattgaactgatggcttgttcagataatgtaattcgaggtggtttaacgcctaaatatgtcgatattccagaattgcttaaaattgtcgattgccgtgaagtggagcctaaaattattccaacagcccctcaagacgcacgcatatttacttacgccacgccagcaaaagatttcgatttgcaaaatattcaatatgaatgtggcgaaacacatcatttaaaagcacaaagtgcgagtattttattagtaatgaaagggcagttaaatttacgctcagaaacgaccgcactttctttgaaacaaggtgaggttgcttttattactgcaaatgcttcttatgaagtggacggcttaattgaaggctatgcagtggtcgcaaaattgccttgataaagtcttaccaaaaaagtatagtcctcttaatcttttattaagatttatttgttttaatacacacatccaagcaatggtgcttgaaattaactaacttaaaaaggaaacgttatgaaaaaatttgcattagcaacaatcttcgcattagcaaccacttcagcatttgctggttttaatggcaataatagtcaaggtggttttcggcaaacagcgcctgctgcaattagcgtaaagcaagctttatatgcggctgataattcaatgattactttggtgggtaatattacacagcaaattgatgacgatgaattttggtttactgatgggacagggcaaatcaagattgaaatcaaaaaacgcgtttggaatggtttaaacgtagattcaaaggataaagtgaaaatttatggaaaattggataacgaagcctttgagaaagcagaacttgatgtattgcgcgttgaaaaagcagaataattatctttgaagatagcgggcgttagctcgctatttttgtctataaagtgcggtcaattttttatgagaattttattgatagaagacgataatctaatcggcaatgggttgcagattggtttaactaaacttggttttgcggtggattggtttaccgatggaaaaacaggaatggctgctttaacctctgcatcttatgatgcggtggtattggatttaaccttgcctaaacttgatggattagatgtattgcaacaatggcgatctaatcatcaagatgttcccgtattaattttgactgctcgtgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctagatcagaatcaacgttctgtttggctgaataatcaacccatttctttaacaagccgtgaatataaattgcttgaattatttatgctgaataaagattgcgtattgtctcgctcatccattgaagaaaaattatccagttgggatgaggaaattagcagtggcgcattggatgtgcatatttataatttacgccaaaaattggggaaacaatttattcgcacggtacacggtgttggatatgctttgggacaagttgaaaaatgaaaaatagaagccttacgttgcgtcttatttctgtgctttgtttaaccgcactttttgtttggctgggttctacgcttgtggcttggtggcaagttcgccacgatgtgaataaagtttttgatgcacaacaagttctctttgctgaacggctcgcaaattcagatttaagtactattttgttggaatctagcacaacgctaaataaaaattcacagtcggtattaaaaaaaagttatgacgatgatgccttagcctttgctattttttctaaaactgggaaacttttattcagtgatggacgaaatggaaaagattttatttttaattataaaacggggttttataatgcgaatatttatgatgatgacgataaatggcgaattttttggcgtatggcagctaatggagaattagttatcgcagtagggcaagaattagattaccgtggaagatttaattgaagaaatgattttggggcaaatgtggatttgggtttggccagttgcctatttggacattggtttaagaagggggattcataaagacttcgacccgattaacggtttaagcccagaacaccatcgaaaaatctgccggatgggctttgccgaacccgaggggtaccccgttcacatttccctttgaaac

SEQ ID NO: 339 - DNA, 2627 bp, H. influenzae
  misc_feature (1410)..(1410): n = a, c, g, or t
  misc_feature (2397)..(2397): n = a, c, g, or t
  misc_feature (2440)..(2441): n = a, c, g, or t
aattttcggtttatttaaacactttaaagtggtgggcgataccggtctcgacccagtgaccccctcctgtaagggaggtgctctcccaactgagctaatcgcccactagaagcgtttaaatataaagggaaagtttgagcggaaaggacactttagaaaagtggtgggcgataccggtctcgaaccagtgaccccctccttgtaagggaggtgctctcccaactgagctaatcgcccgcttggtcaaacttagtaacattaagaacactttttagagaagtggtgggcgataccggtctcgaaccagtgaccccctccttgtaagggaggtgctctcccaactgagctaatcgcccttaatgttgtgggttggcattatagggagaatgcattttcagtcaatacctttttattaaattttgtttaattgtcgtaaaaataagcataaaatccgcttttttatttagaagtcaaacaagtcgtagtagaataacgactaatattttattgaagataggttataaagatgaaactagatgctccttttaatttagatccaaatgtaaaagtgcgtactcgttttgctcctagccctacaggttatttacatgtaggtggcgcacgtaccgcactttattcttggttatacgcaaaacataataacggcgaatttgtattacgaattgaagacactgatttagagcgttcaacaccagaagcaacggctgccattattgaaggcatggaatggttaaatcttccgtgggagcatggcccttattaccaaactaaacgctttgatcgttataaccaagtgatcgatgaaatgattgaacaaggcttatcatatcgttgttattgtactaaagaacacttagaagaacttcgtcatactcaagaacaaaataaagaaaaaccacgttatgaccgtcactgcttacacgatcacaaccattcacctgatgaaccccatgttgtacgttttaaaaatccaactgaaggctcggtagtatttgatgatgccgtacgtggccgtattgaaatcagcaacagtgagcttgatgatcttattattcgccgcacagacggttctccaacttataacttctgtgtagttgtagatgactgggacatgggtatcacacatgttgtacgtggcgaagatcatatcaacaacacgcctcgtcaaattaacattttaaaagcgattggtgccccgattccaacctatgcacacgtttctatgattaatggcgatgatggtcaaaaactctctaaacgacatggcgcagtgagcgtaatgcaatatcgtgatgatggttacttacccgaagctttaattaactatctgtttcgtttaggctggggacatggcgaccaagaaatttttagtcgcgaagaaatgatcanctatttcgaattagatcacgttagcaaatcagctagcgcatttataccgaaaatttacaatggttgaatcaacattatatccgcgaattaccgccagaatatgtggctaaacatcttgaatggcattacaaagatcaaagcattgatacaagcaatggtcctgcattaactgatattgtctccatgcttgcggaacgttgcaaaaccttaaaagaaatggcaagttcaagccgctacttctttgaagagtttgaaacctttgatgaagccgcagcgaaaaaaacatttcaaaggcaatgctgctgaagcgcttgcaaaagtgaaagaaaaattaaccgcactttctagctggaatttacattctattcacgaagccattgagcaaacagctgctgaactagaagtgggcatgggtaaagttggcatgccattacgtgtcgctgtgacaggttctggtcaatcgccatcaatggatgttaccctagtcggtatcggcagagatcgcgtacttgtgcgtattcagcgcgctattgattttattcatgcacaaaacgcttaatatttaatcggataacaaacgcataataaaatcgtattgacagccacatagtcaaattttatcatgtcgctgtcttttatggggatatagctcagttgggagagcgcttgaatggcattcaagaggtcgtcggttcgatcccgattatctccaccaaattaataaagcaaggttatttaccttgcttttttattatcaataatcaatatcttagcgaattttaacaaaaataaaaactaaagcgtgctagaatagtgcgctttttattacatcgttcgaaatcatatcaaggaataattttgcgtccaaataatcgagaaaataatcaaccccgccaaattaaaattacccgtaactacccaagcatgctgaaggggtctgtgccttggtgaaatttgggacaccaaaagtgctttgtactgcacagntgaaaaatgctgtgccacgtttcttaaaggacaagggcagggnntggtaacggctgataagtggaatgtggcacgttcacaccatagtcgatggcaacgtgaggcggcttaaagtaaaccaaggtggacgcacaatggaaatcaacgctaaatgccccgtcttgccccccagggggggatctaagcactgggggaaccggcataccttaaaaaggggatgtatccaacgg

SEQ ID NO: 340 - DNA, 1883 bp, H. influenzae
  misc_feature (1454)..(1454): n = a, c, g, or t
  misc_feature (1507)..(1507): n = a, c, g, or t
  misc_feature (1597)..(1597): n = a, c, g, or t
  misc_feature (1601)..(1602): n = a, c, g, or t
  misc_feature (1700)..(1700): n = a, c, g, or t
  misc_feature (1702)..(1702): n = a, c, g, or t
  misc_feature (1726)..(1726): n = a, c, g, or t
  misc_feature (1728)..(1728): n = a, c, g, or t
ggtatcgaattcggactcggtacccttcacgttgtcatcagaatatcttcaatttctaccgcactttcatcgtcagaaatatcgtttgttaaagccagtttgataccgcgaacacctgttgctaaacgccccattgcacgcacggcattttcagcaaaacgcaccacgcgaccttgcgatgagaacaacataatttcgttgctgccatcagtaatatccacgccgattaattcatcttcgtcacgtaaattcaatgcgatgataccgtttgaacgtggacggctaaattcggttaaggcgattttcttcacaataccgccagcagttgccatgactacgaatttatcttcttcgtaagcagaaactggcaagattgcagtaatacgttcgttttcttgtaacggaagaatattcacaattggacgaccgcgtgcaccacggcttgcttgtggaagttgatatactttcaaccaatataaacgaccacggctagagaagcagaggatggtatcgtgagtatttgccaccagtaatttttcgatgaaatcttcttctttcatcttcgttgcagatttgcctttaccgccacggcgttgtgcttcatagtcagtcagtggttggtatttcacataaccttcgtgagaaagcgtcacaaccacgtcttcttgtgcgattaaatcttctaaatcaatatcgccagaagcagcggtaatttcagttaaacgatcatcgccaaattgtgctttcacttcttctaattcttcacgaatcacttccattaaacgttctgcgctacttaaaatatgaagaagatccgcaattttaactaataattcttcatattcttttataacttcttcaaacgcaatgcccgttaaacggtgtaagcgaagttctagaattgcgtttacttgcgctggcgataagtaatactgttcaccttgaataccaagattttcttctaactcatcaggacgagcggaaacatcaagaagattaataatatcgctatgtaatgtccaagaacgtgaactgattgctgttgcggcctcttcacggtttttagagttgcgaataattgcaatcatttcatcgatattagaacgagcaaccgctaaaccttccaaaatgtgcgtacgttcacgtgctttgcgaagctcaaagatagaacgacgtgtcaccacttcacggcggtgtaaaacgaaggattcaatgatttctttaagattaaataaacgtggctgaccgtgatccaatgccaccatattgataccaaaggtcacttgcatttgagtgagtgagtaaagatggtttaataccacttcccccactgcatcacgtttaatatcaatttcaatacggatcccttctttgtttgaaaggtcagtaatattgctgatgccttcgaattttttctcgcgaataattcggcaaatttctcgactaatttgctntattacttgggatggcaattcagacacgataatttgctcgcgtcctttttcgnttgggttctacgggtgcacgagcacgaacatatactttaccacgaccagtgcgataggcttcttcaatccctttacgaccattaattatnccanncgggtggaaaagtctgggccccggaatatgttgcattaattcatcaatggtaatttcatttggttggcaatataagccaaacaaccatttatacttcngnttaagtgggaggggggaagagttnantggcccttcccccccgcatacccgaagaacatttggttaaagtgctggataccgagttgcaatacatctggggatcattaatcgccttatagttttgcgagaaagggccggttctttatcccatcaggagcaaggctggggatttttttgtacga

SEQ ID NO: 341 - DNA, 2200 bp, H. influenzae
  misc_feature (2186)..(2187): n = a, c, g, or t
attcgactcggtacccttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttagaataaatagcccgattgaatctaatcgggctttatcataactataattaagcaaaacctaactataatgtccattatacaagattaatcataaatatacttttttgaaaaaaatttacagaaaatttatcttaatataggagatatattaagataaatacatcattaaagaatgtagagataataggtataatcccctatactaattttagtattctttgaagagcaaatttaaataataaatccaaaataaatacaatatctgaaattatagatgagggggatccccctagagtcganncctgcaggcatgc

SEQ ID NO: 342 - DNA, 2158 bp, H. influenzae
aatcgtcgcgatggattaacgggcagcgaacaaattttttgcgtgggatttaaagaattttcacgtttaaaacaagtaaatccagacgcacctgaagcgattattaaaggcacaatgcgtgcgatgaatcttgcgatgaaccgtgagattgaaagtttggaaaaccgagttccatttttagccacagtggcatctgttagcccttatattggtttattcggcactgtttggggaattatgcacgcttttatggcattaagtggtgcaaaacaagcaacgttacagatggtagcaccaggtatcgccgaagcgttgattgccactgcgattggtttatttgccgcaattcctgcagtaatggcttataaccgtttaagcttacgagtgaatgccattgaacaagattacggtaattttattgatgaatttacgacgattttacaccgtcaagcctttggtaaagcccctcactaaaaatagggaaaattgaccgcactttgaagaaaaagtgcggtaaaaataagttaaaattttagaggaatatatggctcgtcgtcagcgtaaagcaattaaatctgaaattaatattgtgccttttttagatgtgcttttagttttagtgttaatttttatggcaaccgcccctattattagtcaaagcgttcaagttgaattgcctgattctgtgcaaagccaagaggtttctaatgaagataaagtgcccgtcattcttgaagtggcaggcattggaaaatatgcgatttctattggcggagaacgtcaagaaggtttaacagaagaaatggttactcaattatctagacaggaatttgataaggataataatacactatttttagtaggcggagctaaagaagtgccttatgaagaagtgattaaggcattgaatttacttcatcttgcaggcattaaatctgtaggtttaatgacaaatcccatttagctaagtaggtaacacgtgcaaaataatcgacaaaagaaaggaatcaatgcttttgctatttctatccttttgcactttatcttgtttggcttattgattttaagttcgctttatcacaccgttgaaattatgggtggtggagaaggtgaaggagatgtaataggggcagtgattgttgatactggtacggctgctcaggaatgggggcgtattcaacaacaaaaaaaagggcaagcggataaacaaaaacgcccagaacctgttgtggaagaaaaaccacctgagcctaatcaagaagagattaagcatcaacaagaagttcaacgacaagaagagattaagcatcaacaagaagttcaacgacaagaagagttaaaacgtcagcaagaacagcaacgtcagcaagaaataaaaaaacaacaagagcaagctcgtcaagaagcgttggaaaaacagaagcaagctgaagaggctagggctaaacaagcggctgaagctgcaaaattaaaagcagatgcagaggctaaacgtttagctgctgcggcaaaacaagctgaagaagaggctaaagcgaaagcagcagaaattgctgctcaaaaagcaaaacaagaggcagaaactaaggcgaaactagaagcggaagctaaggcaaaagccgctgctgaagctaaagcaaaggctgaagcggaggcaaaagcgaaagcagcagctgaggcaaaagcaaaggctgaagcggaggcaaaagcgaaagcagcagctgaggcaaaagcaaaagctgatgcagaagctaaagcgaaagccgctgctgaggcaaaagctgctgcggaagcaaaacgtaaagcagatcaagcaagcctagatgatttctttaacggcggagatgttggtggcggtagtgcatctaaagggggaaacacaaataaaggtggaactcaaggtagcggtgctgcacttggctctggcgatggtggtaaggttgtggatcaatacgcaggtgtaattaagaaagagatcaacgtcgtttcttaaaagatccatattttgcaggaaaggtttgtcgtattaaattcaattaggccgagatggcccattcttgggggattaaaaaatttcaggctctgaggattttgtctcactgctttaaggcgggggttaaacgaaaaagttcccctgcgcctccgataaaatttatgc

SEQ ID NO: 343 - DNA, 1912 bp, H. influenzae
ataaaatattgaagatttagttggtaagaatagtattttctattcttacctttttatttcgtttttagaggtttttgatttttataattcttataaaagatatgaaattcttttataaaaataaggggagtttatttacattgatatttaaatagcagaatttattgtcctattacctaaagtaccatcatcaatcgcttcttttggcgtcccaataacttcggcgattttctctccatttttaaaaaacacaaatccaccattttccatttttgtccaagattcatctttggttaaaggaaatgttgtgatgatattgaccttatctcctgcttttgcataattgctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagttcttgtgttactttttgaattgcttcaaaaatttccatttcacttggttttttgcggaaagtatttttaagatactcagccatataacagaaagcagcttcagaatctgtagaacctattggctgtaaaaaatgatctgtcatatctggtaagttttttaaattaccattatgtgcaaaaacccagttttgtccccaaatttcacgaatgaacggatgggtgttttcaatattgacttcgccttgtgttgctttacgaatatgcgcaatgacattaagagatttaatattatattgttttacacaatctgcgatgggggaaagactggctgtttgattatcacgaaaaatacgtacacctcgtccttcaaaaaaagcgaccccaaagccatctgaatggcaatctgttaaacctgcgcgacgacggaaaccttcaaaagaaaaaacaatatccgtcggcgtattacaattcattccgagtaattgacacataattttaattagatataacctcacaatatgtgagtgatttaacaccattatagggagaatatcaagagagatttaatgaatttttatgttgtatagatattaatgatagaaatggtatttaatctattattttttattaatattctttatttttaaagaatggtaaaaaccactgatatttgaaaagtcattgcttagatagaattaacctcctttgcaatttaaccaagttacttgcttgccttgttgattcttgtagtaaattgaactttgagatcgcacgattaaatctacataacttccttgaattggatcatacgaacgataaatcgcttcaaattttgtaccacgggtattgagtgttagcgtatataaatgatcaaaaggtatcgctttgccattatctaactgaaaataaaaactaaaattttctttcatacggctttcacgcgacagagggaaataagtcgtcaaatgagaaattcccccagtttctttattattacaacgataatgatatggcttgtaattaacagaattatttaactcagtttggctaatattattctttaaaaatcgagatttaaccgttttcttcggctgatgtattgtggtacaagcaaataaactcacaagagccccaacaaacaatgccatctttaatttattcataaatacaaaattcggagaaataagaggcgcgtatgatagcggaaattggggactgtgcaagggattggaatgagactaaaaaatgcaataaaaactggaaatgtaattccaaatacatacaaaaaaataaaatatggaaattaacttccaaaccttgtacactttttacaaatatgaaattaacttccaatgagtaaaactatgtctctcgtgaaaattattcagcaatgatcaagggacgagccgaatcgaacag

SEQ ID NO: 344 - DNA, 1949 bp, H. influenzae
  misc_feature (1837)..(1837): n = a, c, g, or t
  misc_feature (1930)..(1930): n = a, c, g, or t
aaatccagtaagaaattttccagccattcaataacttccacatccaagtggttggttcatcaagtaataacacatcaggatcgcataccaatgcacgtgctagtgccgctttgcgtaaccaaccgcccgaaagtgcggataattttgtggttcgattttgcattatattgcagaaattagaaacgaatgtggtagttatgcttctcacggtcaagatatagaacacaaacaaataagtagtgatcttgctttatttgtacttcattcaaccaatgcaattttaggatttattctacacttttacattgctacaaatgattaccgtagaagtgaaaggatacaatatgaagataatcaaagaatcaacgaattaattgatgaggcgtatgaaatggaaacaatatataaaatttcatattcacaagcattatttgctcaagatcctgatacctatagagaaatggtattggagtttgagcaaatagaatatgaacggttgatggacacgctctaatttcttacaaggttcatttcacctatgccaaatttcccctaacccctctttgctaaagagggggactatttggaatgtttagctgcaagcggtcgaattaacagaaaaattattcatgaaaacacctaaactaaaactacgctcaagaccattcccctcttttgtaaagaggggttaggggagatttaaaccacacactaaggaactcatcatgctcaacgaaaacgatatcgaacaactcactcttcaacgcctgcaatccctcggttgggaatatcgctacggtaaagatttgcctgttcattagataactgagttagatcctgttgcaagatcgatgatgcggaaaattaacgcggtaggtttcacaatatactggctctaactcaatggaaagtaactggcgaaatccagcataatcaaatcctagagaaagaccgccagcaccagaaaataaatcgagataagttaatgacatataaaattaaaataataaaaaacgagagatattgtatttcagatagagcctttaacacaagcaaccaagcttacttaaaaaacactaaactaattttaatccacgaaactgtggataaccatctggttatattccacttcccattatatttcgttgttttttatgataaacaagtagcccctaacctttcacttaatctttcaataatttaattttttcaatcacatttgttgttgaacaaccattttcaaagtttagcactttaacatcgccaccgtttgcccaaacttctttactgcctgcaatctcttcgggtttgtaatcgccacctttgactaaaagatctggtagaatttcgccgattaaacgttgtggtgtatcttcagtgaaaggcaccaaccagtccacggatgccaaaccagccaataccgccatacggttttcaagattattaattggacgactttcgccttttaagcgtttaacagaatcgtcgctgtttaccgcaacaattagacgatcgcccaatttgcgtgcattttctaaataagaaatatgccctggatgcaaaatatcaaaacagccattagtcatcacaattttttcaccgcgcgctttagcttgtgcgacagcatcttttaattctgcttcactcataatgccaaatccagtttcaggacgagcatgaatcgcattttcaagttccacgggcgaaacggtttgaagtccccaatttacccaccacatttccagcggctacattggctaagtaacaagatttctcaaaagacgtccatctgctaatgcgggtgctaatacgctatgacgggggcaccggctccggnccataaacactttttttgcacgggggggcaatgtaagggtcttgattgggcgaaaaatggatggctttttcaaacccggtaccaaaggggggnaattcaattaaaaaatatt

SEQ ID NO: 345 - DNA, 2891 bp, H. influenzae
  misc_feature (2817)..(2817): n = a, c, g, or t
  misc_feature (2839)..(2839): n = a, c, g, or t
  misc_feature (2854)..(2854): n = a, c, g, or t
  misc_feature (2857)..(2857): n = a, c, g, or t
ctggtatacgaatatcggactcggtaccctatcataaagttttatttaagcgaacccattctccacgaactgcacgatgttggaaaagataacggtaaagtttgtcattgtcttgagtatagtcttgttgattggtcattgattattcctaattgagataaaaagtgcggtggttttttccgcactttttgtttttatcatcttatttaagtgtttttgcttataaataggtggtacttagaggcttgtaaaatccaatgtgatctctaagttataatattaattaagcaaatcttgttttggcttctgcaatagcttcggcaacacgcaatggcgatacgccaccttttgcacaacgtttgtctaagcaagattggagagaaagaatctcgtaaacgtcatctcccactacttcactaaattggcggaattcagggatagtcagatcttctaatcctttgcctttctcgattgcataaaccactgtttcgcccacgatatgatgggaatctcggaaaggtacgcctttagagactaaataatccgctaattcagttgcgtttgaatatccttttaacgcagcttcacgagtacgttcaacatttactttcaattcatctaagacgaacgttgccatatctacacagttttgccaagtatctaaggcatcaaaaatgccctctttgtcttcttgcatatctttattatacgcaagtggcaagccttttaaggtgattaacatagatgttaatgaaccaattactctccccgttttgccccgaattaactcacaagcatcaggatttttcttttgtggcattaatgatgaaccagaagtcacacgatcggatagttccacgaaatttgcttctccgctgttaaagataatcatatcttcagcaaagcgggaaagatgtgccatactaagagaggcgatagaaagtaattctacgatatgatcgcgatcagagacgctatctaagctatttctagttgcgaaagcaaaactaagatcgtgcgcaagtgaatcacgatctacagcataagccgtaccagccagcgcaccactaccaagtggacaagtattcatacgattatacgcatctgttaaacgtgaatagtcgcggtcgaacatttccacatatgccatacaccaatgggcaaaagtgattggttgagctcgttgtaaatgggtgtagccaggcattactgcttgctgtgtgttttctgcggtttgaactaagtggcggtgcaaattacgcacggattcttgtaattcaaccacacgctgtttgcaccacagttttatatctactgccacttgatcggtgcggctacgaccagtatgtaattttttaccaaggttgcctactttatcaattagcttactctcaacccatctatgaatatcttcagcatcatcttgaacaattgcttgcggaattgaccgcacttcacaagtaattcatttagtgcttgctcaagtggatgctgttcttcacagttaatacatccacttttactaggcccttggaccagccattgagcctgaatatcctgttctgcaaacgatagtcataacgtgatgaggcattaaaactttaaaacgcttatctgcggcttggtaaaacgcccaccccaaagtgccataatttttcctttttgttttaattaattattctattattgtgcatatttattcataaagcaatattctatattaataattaacaaaaatggccaaaatctttcattttgtccattttatttgtattagtgctatttatagcgtttttgccaaatttttgataaaggatttaaattctttacctaatttttcgtgacgaataccatattctacgaaagcttccatataaccaattttatcgccacaatcaaaagtttcccctgtcatatgaaatgcttcaacggtttctttttcaatgagcatatcaatagcatcggttaattggatttcatcgccaacaccaattggtgttttttctaacaaatcccaaattgctgctgaaaaaacataacgcccaaccacagcaagatttgatggtgcgtcttcaatagaaggtttttcaacaatactattaatttttgcactttcgccgccattaagctcaatgccaccacaatctgcaacaccatagctactcacattttcttgcggaactggggttaccataatttggcttgcgccagtttcattaaagcgttgaatcattgcagcaagattttcttttttctgatctgcactaaattcagctaataatacatctggtaacataacggcaaaagattcatttcctactaaaggacgaccgcataacacggcgtgacctaaacctttcgcattaccttgacgaacgtgcataatggttacattttttggacagatagaacgaacttcttctagaagctgacgcttcacacgtttttccagcattgtttctaattcaaaagatgtatcaaaatggttttcgatagcattttttgatgaatgtgttaccagcacaatttcttttatgccagcagctacacattcatttaccacgtattgaattaacggtttatccaccaaagtgagcatttccttcggaatcgccttcgtggcgggcaacatacgtgtgccaagaccggcgacaggaataattgctttcatattattatatccattgtttaactaagaggaacctaaatagggttcatctttcgtttgtttaattcgttggtaaatttcttctcggtgaacggatacttctttaggtgcttcaacaccgagtttgacttggtttccacgtacactcnaaaaccgtgatagaaatatctnccccatgaggggatnccntaagagtcgacctgcaggccatgccaagtctggc

SEQ ID NO: 346 - DNA, 2055 bp, H. influenzae
  misc_feature (1819)..(1819): n = a, c, g, or t
  misc_feature (1866)..(1866): n = a, c, g, or t
  misc_feature (1899)..(1899): n = a, c, g, or t
atttaaataaacgtataaacggaagtaatgtgcgcattattggatatcctgttgtcgttgagcgagtagttcagcaaagaaaccttgatgttgtaattcggtaaatttaccttgctgtactatttctcctcgttgcatcacaaaaatttgatcacattgtttcaaatcttcaattcggtgtgtaatcatcagtgtagtttgatgctgacttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaaagcttgattaatttcttcatcgttggcttgaatattgccaagtagtaagttttctttaattgtgccttgtaataacaatggattttgtcctacccacgcaatatgtttgcgccagtcagctagattactttcgcgaagttcttgcccattaattttgagcgagccctcataaggtaaaaagcccagaatcgcatttattaatgaagtttttcccgcgccactttgtcctacaagcgcaacattatgatttgctggaatttggaagtttaacggcttggttaatgctgaaccctgtgtcgaaagcaccactaaattttcggcagaaatttcaaccgcactttctaaagaaattgttttttcattttgatgtacagttaaataatcagattctaaaaaatcaacaatggcatccgctgcaccaatacctgctgcacggtcgtggtaataggtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctcagtttgttcagaagtgcggttaaaaagacgcaaggtttccaaaccgcgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatgaattttatccagaattttttgacgaatatggttgcgtaataattgtccgctttggaaacctatttttttcgcgtgcccataaaataatagcacgcatcccgaagccgataattagcccgagaaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttctttgttgtgcgcgaagcccattttgtaaatattttggccgaaagttattccattggttgggccgggatatanaaaaaagttcccctcttaaaagaagttaaagaggggaaattggttanaagaattatgcctcctgagcattaaaaaacgtnctgcatccaaggctggataccaccagtcccgcgggaggggagggttggcgatatttgggatccataattcgcctgtgggaacccgcttcccaaaaaggggggtgcattccttcgaacagatttacacgattagcctttttattctattgccttgaa

SEQ ID NO: 347 - DNA, 2215 bp, H. influenzae
gccagacttgctgcctgcggtcgctctaggggaccccacaaattatcagaaaaaggtgtaaatgtattttttcgtgatctttatgaaatgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagagtaatgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagagtaggcaatattttgctttcctctaagtcttgaggaaagcaagcaatattttatagataggttacaaaatcttttgtatcaataatacggcattcacgttcggctttctccatacttgtgccaatcatgactaacgcaatcacacgatcttgttcacgacatccgaacgcttctcgtaatgcagtgccattaacccatttccctgaaatccacacattatcaaatccttgtgcttgtgcagccagttgtaatccataagttgcacaacctgcactcaacatttgttcccaatctggcactttagcgatagttggatcgatttttgctaccacgccaataaccataggtgcgcgatgtgctaggttttcggctttcatcaatttttcttccccaagatcaaattctacaacggcagctttaagtagcgtttctaatttatttaagctctcattttccattacaataaaatgataaggatgtaattttccgtgatctggcacacgcattgctgcttcgaaaatacgctcaagctgttctgcattaggtgcaggtacggtcaattttttgtttgattttcttgtggttaaaagtgtaagtgcatccattttattatcccttataagtaaaagtgcggtggattatagcatagtttttgacaaggctttgtgatacgctagtacaaattttttaaaggtaatttgtatgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattatttgaaggggcagatttacccgctgggtaccgagtccgatattcgtatacca

SEQ ID NO: 348 - DNA, 2363 bp, H. influenzae
  misc_feature (1537)..(1537): n = a, c, g, or t
  misc_feature (1709)..(1709): n = a, c, g, or t
tggtatcgaattcggactcggtaccccgcgccgcggattttttgttctgcagcataaaggatgaaaatctttctgaaaaagattaaccgtaaagaacagaaaagttttagtgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaataagatagaatcttaatagtcatgaagggcggatatttctgcccttttgttattatagagcatcttacctctcatcaatgtgggatattcccataaacaagggatttaaagagaggctatttagataaggattcattttgcttacccaatttttttcatttttcaatctgacgccaatggaaatctcagcaattaatttaagcctgagtgttgcagtcagttctatgctttggagtttgccgttagccatttttgtggcgtggctcttagcgcgcaaaaacttctatggcaaatctctgattactggcgtaattcatttgcctttagtgttgccaccagtggttatcggttatctattacttgtagcaatggggcgcaatggtttcattggcaagtatttatatcagtggtttggcttatcttttggttttagttggaaaggtgcggtgctttcctctgccgtggtggcctttccattggttgttcgcgcgattcgactttctttagaaaatattgatattaaattggagcaagcggcgcaaacactcggtgcttccgcttggcgtgtattttttacaataaccttgccgctttctttacctggggttttagctggactcgtgcttggttttgcacgatcattaggggaatttggcgcgaccattacctttgtatcgaacattgcaggcgaaactcaaacgattccccttgcgatgtattcttttattcaaacacccgcagcagaagaacaaactgctcgcttatgtttatttgctatcattctttcattgatttctttgttactgtctgaatggttgagcaagcgaatgcagaaaaaattaggacaaggaaatgttgcaaattaatgtgaaaaaacagctcgggaaacttgccttgcaagcgaatatacaagtgccagatcaaggcgtaaccgccattttcggtttgtctggctcagggcaaaccatcggntgataatctagtcagtggattgatacacccaagatgaaggattcatccgtttaaatgcccgcactttagtggatatggaaagccaagaatcattgccgaccccacttgcgtaaaattggctatgtattccaagatgcgcgtttatttcctcactacactgtgaaaggtaatntgcgctatggcatgaaacatgtctcgcaagatgattttaactatattgtcgatcttctcggtattactcatttattaaagcgttatccgcttacgctttctggcggagagaaacaacgtgtggcaatagggcgtgcgctgctgactgatcctgatattttactgatggacgaaccactttctgcccttgatgttccccgcaaacgcgagctaatgcaatatttggaacgtctttctaaagaaattaatatcccgattttatatgttacacatagcttggacgaactgttgcgtttagctgatcgggtcgtattgatggaaaacggcattgtgcaagcctatgacagcgtagaaaaaatttggaatagccctatttttgccccttggaaaggggaaaacgaacagagcagtgtacttgccttgcctgttcatttgcataatccaccttataaaatgaccgcactttcgctaggcgaacaagcactttggattcatcaagtacccgcgaatgtaggcgagcgagtgctagtttgtatttatagttcagatgtttctatcatactgcaaaagccagaacaaacaagcattcgtaatattttacgtggcaagattacacaaattgagatacaagattctcgagtggatcttgccgtat

SEQ ID NO: 349 - DNA, 2790 bp, H. influenzae
  misc_feature (503)..(503): n = a, c, g, or t
  misc_feature (518)..(518): n = a, c, g, or t
  misc_feature (568)..(569): n = a, c, g, or t
  misc_feature (622)..(622): n = a, c, g, or t
  misc_feature (719)..(719): n = a, c, g, or t
  misc_feature (726)..(726): n = a, c, g, or t
  misc_feature (2762)..(2762): n = a, c, g, or t
tggatcgattcggctcggtaccctaaagaaagagatcccatatagcttgagcatttgcatgtccctgctccgccgctttgcgaaaccacttcaccgcttcggtataatcttgtcttacaccacgcccttcagtataagccaaacctaaataagcctgagcatttgcatctccctgctccgccgctttgcgataccatttcaccgcttcaaaatcatcttgtttgacgccttgcccctcagcatacatcacgcccaaattaaattgaacatttgcatctccctgctccgccagaggtaaccaaagtttaaaggcggtttgatagttgctttgctcataagcggttaaaccttgttggaattgctgttccagcgtatccgcccaagcggtggattgaaaagataatacagaagcacctaaaagtgcggtggtaagaagtgtttttgtgagtttcattttgttttcctattaaattgaatgaatggataatcttttatttttattncactaaattgggctntgaaccatgatgaggaacttgcaaaccataaacccaatgaaaggcttggnngcgtctccacttgaatacgcccacttgaaaataacccttgccctacattccanaattcgcattgtaaaagtgggcattagagctcccctctatttagcttgccataatattcgcagccattttgattaccattatcacaagccttaccanaccattncttggctaaagaattatttacttgacacctctttctcctaaaagatataagaatcccaatatagcttgagcatctgcatctccctgctccgccgctttgcgataccagttcactgcttcaaaatcatcttgtttgacgcctcgtcccttagaatacatatggcccaaattaaatttagcctctgcatatccctgctccgccgctttgcgaaaccacttcaccgcttcaaaatcatcttgtttgacgccttgccccttagcatacatcacgcccaaattaaattgagcctttgcatatccctgctctgccataggtaaccaaagtttaaaggcggtttgatagttgctttgctcataagcggttaaaccttgttggaattgctgttccagcgtatccgcccaagcggtggattgaaaagaaaatacagaagcaccgaaaagtgcggtggtaagaagtgtttttgtgagtttcattttgttttcctattaaattgaatgaatggataatcttttatttttattcactaaaattggctttgaaccatgatgaggaacttgcaaaccataaacccaatgaaaggcttgggcgtctcccatttgaatacgcccacttgaaaataacccttgccctacattccaaaattcgcattgtaaagttggcattagcgttcccctctatttagcttgccataatattcacaacccacttgttcaccattatcacaagccttaccaaaccattctttggctaaagatttatttacttgaacaccttttcccgaaagatatgagaatcccaacataacttgagcacctccatatccctgctccgccgctttgcgatgccatttcaccgctttgaaataatcttgttttatgccaagtcctccgtcatacatcatgcccaaaccattttgagcctttgcatttccctgctctgccgctttgcgaaaccacttcaccgcttcaacaccatcttgttttacgccacgtccgattgcatacatcgcacccaaatttaattgagcatctgcatccccctgctccgccgctttgcgataccagttcactgctttgaaatcatcttgttttacgccaagtcctctttcatacatcatgcccaaaccaccttgagcctgtgcatctccctgctccgccagaggtaaccaaagtttaaaggcggtttgatagttgctttgctcataagcggttaaaccttgttggaattgctgttccggcgtatccgcccaagcggtggattgaaaagaaaaaatagaagcaccgaaaagtgcggtggtaagaagtgtttttgtgagtttcatttgttttcctattaaattgaatgaatggataatcttttatttttattcactaaaattggctttgaaccatgatgaggaacttgcaaaccataaacccaatgaaaggctggggcgtctcccatttgaatacgcccacttgaaaataacccttgccctacattccaaaattcgcattgtaaagttggcattagagctcccctctatttaacttgccataatattcgcaaccattttgatcaccattatcacaagccttaccaaaccattctttggctaaagatttatttacttgaacaccgctttgtcctaaaagatatgagaatcccaatatagcttgagcatttgcatatccctgctccgccgcttggcgataccacttcaccgcttcaaaatcatcttgtttgacgcctattcctcttgcatacatcacgcccaacatcaattgagcctctgcatttccctgctccgccagaggtaacaaaaatttaaaggtggtttgataatcgcctctcgtagtggcttcagaaccttgttggaattgctgttccagcgtatccgcccaagcggtggattgaaaagaaaagatagaagcacctaaaagtgcggtggtaaaaagtgtttttgtgaatcgcatagaaatcgtccatttattaatcaacaattgaaacaaccaaacattttttgtttagcattatgttttgttgtaggggtctcntagagtcgaccgcaggcagcaagctggc

SEQ ID NO: 350 - DNA, 1963 bp, H. influenzae
  misc_feature (607)..(607): n = a, c, g, or t
  misc_feature (701)..(701): n = a, c, g, or t
aaaaatttcgttatatcgatcgcatcaaaacacaaaaaggcgaaatactgcaaaccagttctgaaatttacggaaaatcgaatgaaaactggcaaaatcaaattggtgatattttagagaaactgttgcctgctgggtctattagtggtgcaccaaaagaaaaaaccacacaaattattcaacaagcagaaaaacaaaagcgcggttattacacgggaatttttggcatatttgatggcaaaacactacaaagtgcggtagcaattcgatttatttctcaagtagatgaaaaattttattttcatagtggaggcgggattaccattcatagcaatgcgcaagatgaatatgaagaattattagaaaaagtctatttaccgattgaaggtgctgattaatgtatcctctatttgaaaccctttgtattgaaaacgggaaaattcaaaatatcgatttacaccaagcgcgatatgaacgtagtttgcgtgaatattatggcaaaagtgcggtgaaaatttttaatcttttttcccttattcaactgcctgaagatttacaaaatcaattagttcgctgccgcattgattacaatgccgaaaccacacanattcaatattttgaataccaacgaaaaatctaccgcacttttcacctgtaatttgtgatgacattgaatatagtttgaaatatttagatcgcangtttaattaatacattatttgctcaacgtggtgcttgtgatgaaattatgattatcaaaaatggaaaagtgacagattgttccatcggtaatttaatttttcgccaaggaaaaaaatggtacacgccagacacgccattgcttttaggcacacaacgagaaaaattattacaagaagggaaaattcaagaacgcacaatattccaagaagatattgtcaattttgatgaaattaaaatcattaacgcaatgaatagcttataaaaaataagccgactgatttagtcggctctagttatcctattatttttcagcatttttcaataattctgcgtgtgcttttttctgttctttcattttcgtactcgcttcacggcgttgcttagaaagttcagcattgcgaattgtataatcatccacacggctttcataatcatcacgcatactttcaataattccgcgtacttctgcaatagtcatatcatcacgaatatattgatttaaattatccaataacaatatgcgtttttggttatcgcgaatcttacgattattgtcttccatatctcgtttaattctattttttaaacgatacatacgcacgtattccaacacttcttgaaaagattgtttattcacaatttccataacaactccctttaaaataaataaaatgactgtgccgtaatttagcttttttttaatcaatcgtcaaaatttaccctctattttatgaatgatagaaagaatttttttgatttcagtaaaaagcattgattatcgatttttgtagtgataaaaaagacatcattattttcataaaaagcaaggaaatacaatgtcacaagtctttaattttagcgcaggtcctgcgatgattttcccagaagtgttgcaaaaagcacaaaatgaacttacaaactggctcaatcaaggtgtttctgtaatggaagtaagccatcgtggaaagtattttatggaactcgttacccaagcggaaaaagatctacgtgaggtttacaatattcctgataactatcgtgtacttttcttacaaggtggcgctcgcggtcaatttgccgcaattccgatgaacttaatcggtaaaaaaggcaaagccctttatttaaatagtgggcattggtcagctacagcggcaaaagaagcaagaaattttgcagaaattgatgaaatcactatcgtagaaaatggcgaacagactcgaattaccgatcttgattttagccatatcgctgatcaata

SEQ ID NO: 351 - DNA, 2244 bp, H. influenzae
aaagaatttttcttaaggcgggttttgatcggcctccaaaaagatatgtttatgcttcccggctggggaaagaatatgaaaaatgcgcgcaaaattcccggcacttctccctaaaattcgagatggtccctttattggaggatgccatttcaaggccgtgaattggcgtttaaattagggttaagtggtacgcaaaacaaacagttacagaatatctttatgggcttatctcgtttgtttttagaaaaagatttatctttagtggaagtcaatccacttgttctaactaaccaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacactaatggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttgggtgtgtagcgatttgtcgggaactttcaacttatgcaacggtaaataataccgcttatcgtttgattaaaaataatacgcccagggcgttatacttttattcttacagcaacgaaagaatacctcggccgtttaatgacatcaaaaccgtaaaccattggtttacgcgtaccaaataataaaatgctttagatta

SEQ ID NO: 352 - DNA, 1963 bp, H. influenzae
  misc_feature (30)..(30): n = a, c, g, or t
  misc_feature (33)..(33): n = a, c, g, or t
  misc_feature (36)..(36): n = a, c, g, or t
  misc_feature (48)..(48): n = a, c, g, or t
  misc_feature (1684)..(1684): n = a, c, g, or t
  misc_feature (1715)..(1715): n = a, c, g, or t
  misc_feature (1758)..(1758): n = a, c, g, or t
gccatacttgctgcctgcaggtcgacttcnagnagnatccccccgcgnataacctaaggctgcgattaagaaatattctgaaattggccgcactttggataggttgtttacggcggcggaggttaaatagattgtaataatccgcttgttgctgttcaaaatgaggcacgtttcccaccattggggcaagatctcttacagagcagcggatgcctacacgagcgagattatctgatgtattcacatcttgagtccaaggttgggcgatattttgttggagtttttgttggttttcttgttgttcttgttcactaaagtggcgatcaacattatcacgaacatggcttgcgccgatgcaatgtgaggtttttaattgattggctggagtaagatagccatcataacaaagcacagatttcagtttgagtaagttttctgatgttggaatttggctaacttgcccgcggatagggtagagcggtagcttttctgtttgaacaaaatcagtaattttatatccgttcgcaagaatgacgacttcatggcagtatttttgaccttgcgtattttctagttcccaacctttttcttgttgagaaagtgcggtaattttttgtgaggttttaatgattacaccttgcttttcaagaaatgaaaaggcattttgaacaaattgtcttggtgcaagccaagccccttgttcaatccaaccgccttcgcaattaagcggtaatcccactttttcactgagttgttcagcactcagcatttggaagatttcgttcggtaaaccaagttgagaaatctttgttaatttaaccgcacttttttcgttgtaagcacatagtgccacgccacaaaattcgtgctcaaactctatgtttgttcgatcgcccaaatcaagtaattggcgaccgtagctaaaagcgtgcaggtaaaaatcaaccggtgagcgcattatcatcgctaagttgcggataaaatgcgccttgtttattgcctgaggcattgagagcgagcgcatcatcttcacaataaatggtgacttttgccccacgttttactaaggaaatggctgcacaaaaagaagcgataccaccgccgataatagcgacatcttgtttttccattttcgcaggctgagcaagataccaaggtgtggaaagtacggtagattttgattgtatttttagcccacttaaacattcccgttttttgccaaagcctttacgttttgtcacattaaagcctgcggattcaagtccttttctaaccgcacttgctgcggtgaaagtggcaaaagaaccattgggttttgtgaaacgaaacattaatttatagagatcatcattccacatttcaggatttttgctcggcgcaaaaccatctaaaaaccaagcatcaatacgttcattcatataatcaccaagttgtggcaagttttctgatacattaccaagccataaatctaacgttgtctctccaaaatgaatacgatgacaacctagaatcaatgaaggccaataacgttgcaaatgagcgcttaaatcttcaaactgcggataggcaaggtgcgcttgcgaaagtgcggtgatttttagcggatatttttcaaaggaaataaaattaaggcgttttaaaggaatgattctcgtgttgctggcgaaattcacggaataattgngttaccgcgaagatatttaatcctgtaccanatcctgtttcagcaaatgacaaattagcctcgttgtggctatnccacgttcccaagttgataccttgtagaaacataatctgtttcgctaatcattttcgtagaaaaagacatatggattgatctggacggaatatggttcgaattgagtgatctcagatgtgccgctaaaggcatttattccttctgctaagaaattgcgatataccatttctgactgtcacaagatatgctgaaaattatttcaaa

SEQ ID NO: 353 - DNA, 1797 bp, H. influenzae
  misc_feature (1504)..(1504): n = a, c, g, or t
  misc_feature (1663)..(1664): n = a, c, g, or t
  misc_feature (1698)..(1699): n = a, c, g, or t
  misc_feature (1709)..(1709): n = a, c, g, or t
tgattggggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaattgagaagtgcggtaaaaatttctctcattttttaccgcactttcttcgttaaagttgctgaatatccagtgccatttggtctagcatttcataacgtttacgatacatagaacgttttttacttgcgatatcttctaattgtttgcgttcaatatgcaaaggtaattgccaatagttatggcgatattctccttggttttcttgccaaaattcatcgtaattaaacaaaatcttactgcgagcagaaagacggtattttccttgtgctttgtgcggaatgcccactaactcacattgccatttttcagcaagcattttgaacgcattaaccaacataaacattggtcgcataccgtgtaatgctttcgtagcctgtttcacaagttcttgtgcattgtcgcttgaggggccttgaattgaggcgataagcaatttattcgggcttaaaaaagtgaaagacgcatcatatactcgttcgttattttgattgcgaatattaatagaaaaatatccttcaaagggatcgatatgattaatactcaacgataaacgcaaatcctcagttaattgggttagcacgatatgttgttgatctaataattgttggcaaagcgaacgtcccattttttcttctgccaaacgtaaattctccgtaatcgccgttaaacgttctgaagcagaaaaacgtttatcgcaaaaggtcgtcagaattgtattagtacgataataatcttgtgtaaataaagactgccattgcgtttctgtattaaggaaatccactaattgatgacattgcttttgatataaccatttatagccataatagcgtaatttttcccgcacttgtttaagaaaagggcgatccttagaataaggatacatttgaacgtaagtggggaaaataaaatgatttttcgtggacataactcaatattttgtgaaatttaataaaatttttcgttattttagccattatcacttcatttgccaaaattcttttttgtttaaaacccactttataactcagattttgttataatcttttccttgaattcctttttccctaccccaatatttacccaaattatcggaacgaaattataagagagaccaattatggcgaagaatacccaacgtacaatgcccgtattgccattcgcgatgttggccgttttcctttatgggngtgccctttttgtaggcgcgtaaatcaattatgcccttgagaacatgaacgatgacaacgatttttttgtatccaaagagagctgatttggagacctaccctgagattatttgtggggggaaccatgctactttatcagtattaaatacctgtgcacgnnaagtgctagttgaggtaaatcggcgaaattacgnnctgagacgcnaaaaggcttttcgccaataccctatcgacctatggcataaaaagataagggcaaaaaaggcgccttttgggttgaaatactacctacc

SEQ ID NO: 354 - DNA, 1884 bp, H. influenzae
gaagagacaacgaaataaggaacagagcaataaaaaatcgaaagtgggaaagggggagaaaaaacaaaaaggggaaagaggagggagattgggtaaaagaaaagacaaaagggtgaataggaggttgattgggggaatttgagtgaaggccgagtcattatggaaaaaggtgaaaaacgaaaaagtgtccataccgatgatcaacagaatttcaagccttgagcatcgaaaatattcgagacgttttaccacgctttttttaaatctgcaaacgtataaatatctacatctgcaatttcacttaactgtacaaggtagtcattaaattgtggcaactcaattttgaatactttatcaggtcgccaacttggtacaacatcaatatcaaaactttcatcattcttgattgcttgatgatattgcaaagaatcaatgggatcatctgttgtccccactaatttcacgttcattttctgcataatgcctcgcgcagaaaattcaggttgttgcaacatttcattacattgatgccaaattttttccgcattttgcggattaaataacatattggttataccaaaaggacggcgtaattctaaatgtgtccagtgataaattggattaccaatacaaagggggactgttttcgcccaagccaaatatttttgatagttagtagccttccctgtaatcaattcttctggtactccagctgtacgcaaagctcgccatttgtagtgatcaccctctagccaaatttcagctaaatcattaaattgacgattttccgccacttctcttggatttaaatgacagtgataatcaaaaataggtttatttttggcataatcatgatagagaatttttgctgtatccgttgaaagaaggaaattttcatccataaattgcttcattttgccctcctatactccactatacgcagaaaaaccgccatcaacaggtaaaactacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagtgcggttttgattactaactaaaaatcctggtgcgatagcattacaacgaataccaacttttgagaaatatacagcaagccattgagtaaaattactgattgcagcttttgcaccagagtaagcaggtatctttgtaagtggtgtaaaggcattcatactggaaatattaataatatttgccccttgtttaccaagcatatcttttgaaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcaatagctatttgatcacgcacttctttaatattttcaagttctaacacattagttttataagcttttgcttttccacctgattggttaatttcttttgctgctttgtctgctgcctcgaaattcaaatctaacaaggcaatattagctttagtatacgctaactgcttagctagaaatgaacatagcactccgccagcccccgtgattataattagtttattttctaagttatgggttgctgcaatattcatagtaaactccattaattaaattcagattgaagatgagacgttgcgactttatctatatcgcacctttatattgatgatgatgccagcaatacgattgccttgctgacaacagttt

SEQ ID NO: 355 - DNA, 1952 bp, H. influenzae
aaggcacaaaagttagaataattccaatacctttccaaattataaaagaaacgcgccgccttttgcgaccgttgggatattatttatcctgtcaaaacagcccggaataattggattggccaaaaataatgtcgccagcaaaaatacatataaaatccacgaaacaatcggattgcttggtgtatcatcagcagtaatttctttaattgaggttgcattgcgatattcatccatcatcgtaatacgccaaccatagtatttaatttgcacaagtttgttgtcattacccaaagcctgcgcttcagcctgtaaattggccgatccaaatttgaaatagaacgggaaaccccaacgtgtatcttcattgcgatacaccataattttgccatcgtcattttgcgtattgatgtaatatacatcgcgtgttgggccatcagctggattcgattttgtgattgggccatctttatcaacacgtttaacttctacgccagtaacacgcgtcacatcataatgagggaacacataattcaccacagaaaacataaaaccgtggaataaaaaaacaacaataaataagaaatatttaaaaaactttcgcatatttttcccttgtcagaactgtacatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgatccattggcacataacgaataacctcacgaatcgcttcggcatttttaaaggttacaatgccagaacaagaaatgtaaaatcctaaatccaacgcttttttcgcaaattccatggtttccgtaaaacaatgaataacgccaccgcacttttcagcatgatgttcgcgtaacattgcaatggtgtcatcgcctgcagaacgtgtatgaataattacaggcttatctaattggtttgcaatatcgatttggctaccaaacaccgcttgttgtgccgctttattgtccgcactgtaataataatctaagccaatttcgccaatcgcaatcacttttggatcttgcgataaacgcaataagcgttctgcgtcataaggttcctcttcaaaatcgaggggatggacaccgcaagcaagcgagacattattaaattcccgtaaagagtcataagcctgctcaaaacggcttaaggttacaccaatcgcgagcaaatgtttcacatcacgcgcacgtgctttttccaccacatccgagatatttttatgtaaattttcataatccaacgcatctaaatggcagtgggagtcaacaatgaacataattatttttccttatgcctaaggcttgaacaccatagacgatatatctttaatttattgcgtttcaaatacttctgtgactaatcgcgtcaagccatctaatagcattaattcaagattcacaccattaattgtaagcaaatctgaccgcactttttgcataattttaatggcttgtaataaaccaagggcagtttgctcatcgctgaattgttcgatgccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaatcagcccttgttgtaaagtttctaatgctaaaagcggacgcccaagattcatcgcaagtgcggtcaaaatttcctgattttcagccgcactttctgatttcacccatccacggcctttggttattac

SEQ ID NO: 356 - DNA, 1691 bp, H. influenzae
ctccgtatccttggttttatacacgccttggtgtgttgcttgtaaagaatttgaaaagctgacgttttcagatctcacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaagttagaattatttacaataagtaaaaactctttttctgttatacatcttgtttaacaaatagctaatcattactatagctgggttttaatttatctttaaacgaaaggaaagcaaaatgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtagtttagttgtagtttcataattttatccttatttttgcccacatttatgtgggcttttttatgcctgaaatttatcgcattttttaccgcactttaagaaattatatttaatcttttctatatttaagcaaacgtttgcgttataatccaactcgcttatttttaaccatttaatgaaaggaaaatacaatgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaattcggtgcgggtaccgagtccgaatcg

SEQ ID NO: 357 - DNA, 2173 bp, H. influenzae
  misc_feature (2160)..(2160): n = a, c, g, or t
  misc_feature (2163)..(2163): n = a, c, g, or t
cggtctttttcataaattacattcccgaatatcatgctgtgtacgggcccgttcccccggaaattgcccccccgccttgcgttttccgtaaaatcatcctgccccgggaatatcggattttctgcccctagaaagtcattgccattggttattcaatacgcggttttagcgaaatgtgcaaataatctttcggcaagccttgtggcaattccacggtagtgtagtcatcataaagtttaatatgcccaatataacggctgttaatatcgccttcgttagcaatcgcaccaacgatatggcgagcttttacaccatctgcacgaccgacttcgatacgatataaatccattggttgtggatttccatagcctttacgttcgccacgacgttcagctgaacgtggattttcacggcgatcaccgcgatcattacgttcacgacgacgtttttccattggcggatcaggtggaagaattaatttttgtttgccttgaagcagcatcaacattgctgcagcaatatcttcttgatcctgatcggctgtgaataagtcttctaataaactacgatattgttctaaatcgtgatgctcgagttgtttcgtaattttggcgacaaattttttgcggcggcattcttgtaacacaagatgatttggcaattctacttcattgataccttttttcattaggtgttcaatattacgaagtaaacgacgctcgcgaggttcaacaaataataaagcacgaccagaacgaccagcacgaccagtacgcccaattcggtgtacataagattctgcatcaagcggaatgtcgtagttcaccacaaggctgatacgttcaatatcaataccgcgtgcagccacatcggttgccacaacaatatctaaactgccgttacgtaagcgatcgagggtttgttcgcgtaattgttgtgtcatatcgccattaagtgcggcagaacggaaaccatttttttcaagtagttctgtaatgtctaaagtaccagttttagtgcgagcaaaaataatcgctgcatcaaaatcttccacttctaagaaacgaagaagagcttcgtttttacgcacgccgtgtacataccaacaactttggtcgatatctggggcattttcgttattcactttgatcttcacttcttgtggatcattcataaaacgtttcgtaatacgacggatcggttcaggcattgttgcagagaataacgcagtttgatgattttctggtaattctgccatgacggtttctacatcatcaatgaaacccatgcgtagcatttcatcggcttcatctaatacgataaaacgaagttcagaaagatttaatgttctgcgacgaatatggtcaagaatacggcctggtgtacccacaaccacttgtgcgccttgttttaatgcacgaagttggatgtcataacgttggccaccatataaggtaacaatgcgagtgccgtgtgcatatttaacaaattgttcacacgcatcggcaacttgaatagcaagttcgcgtgtaggcgccatcactaacatttgtggatgtttttcacttggatcgatttgcgctaataaaggcagtgcaaaagcagcggttttaccactacccgtttgtgccatacctagcacatcattgccattgagcaaatgtgggatacaagcttgttgaattggagaaggggtttcaaaacctaagtcagaaacagcttttaagatgaactcaggtaagcctaagtcattaaaagtaattttgtcagtcattaaaatactcgaatataaataaggaaagctcaacgggctttcggtttattaagttgagcagagcgaatgaatttttctattcgttctactgcaaagagcggtaagttttggattgatttttagaaaacaatcgcttttgttaccgcacttttctcttctttttcgtcttctgtttgaaccggttttaatttcatgagttcaaacgcggcaaaacgatactcaacaaagttataaacctgatttgccatggctagtttaaataaagctgctgcttcatctactagccctacattgagtttttgttttgctagataaaaataggtttctgtgagaatttcagcatattgtttgaattttcggaattcacttgcacgttgttgtaattnttntacagagatg

SEQ ID NO: 358 - DNA, 2063 bp, H. influenzae
  misc_feature (1917)..(1917): n = a, c, g, or t
  misc_feature (1926)..(1926): n = a, c, g, or t
  misc_feature (1928)..(1928): n = a, c, g, or t
  misc_feature (1951)..(1951): n = a, c, g, or t
  misc_feature (1976)..(1976): n = a, c, g, or t
  misc_feature (1982)..(1982): n = a, c, g, or t
  misc_feature (1987)..(1987): n = a, c, g, or t
  misc_feature (1994)..(1995): n = a, c, g, or t
  misc_feature (2004)..(2006): n = a, c, g, or t
  misc_feature (2008)..(2008): n = a, c, g, or t
  misc_feature (2011)..(2011): n = a, c, g, or t
  misc_feature (2028)..(2028): n = a, c, g, or t
  misc_feature (2032)..(2032): n = a, c, g, or t
  misc_feature (2042)..(2042): n = a, c, g, or t
  misc_feature (2045)..(2045): n = a, c, g, or t
  misc_feature (2053)..(2054): n = a, c, g, or t
ggaattcctaaatggtctattattttataccaaacatcatttaaccggatttcagcgtattgcttgtgacaaagcagtgacaatggggcatattgaacgtgagcatttatctgctgcaaaatgcatagtgccaaatgacgaattattagcaaataaagcattagaaaatattttagaaaaaattatttttaacaggctggaaaatttcaatcttcaaaacacaagagatttattattacctagattgttaaatggtgaactcaatggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaataaaatgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggntcgctttcngnagattttcaacgctttacgccgnggaaagtgggctatgaaaaaaatanaagcgngcggntatattnngaccaacannncncancccgcccatggctttangccnccctgtgatnacnggcccatnnccctttctc

SEQ ID NO: 359 - DNA, 2844 bp, H. influenzae
  misc_feature (2835)..(2835): n = a, c, g, or t
ctactggctcgagaaaacgcggcaacacgagcgtttttgatatggcgcgcaatggtttgtaccgattcaaaatccccttgagaagaaacgggaaaccccacttccattacatccacacctaagcgttcaagtgctaaagcgatctgtaatttttcttttaccgtcaaacttgcttttaacgcctgttccccatcacgcaaggtggtatcaaaaataataacgcgatctgtcataacaatatccttactaaaagttcctctaaaatcactccaaaagtgcggtgcgtttttcctgtattttttagacaaaaaacccgcgacttataaagtgcgggtttaaaattgggtatttacatctgactgttttttatccacaacttagccgcacgcaaaatgtgagagcagcaggttgagagataaagaaacaatacgaaacataaataaaaatccttctgtgtaaaacgttttccatattacgaataaaaaactggctgtcaaactattttttggcattttatattaaaaataaacctactcacactttattaaatatatatttaactaataaatttaataaaatcagaatatttaaccaatttaatcgtcatcaacaaatttttcttattggattttttacattttcaaaataagaaaaattttgcaattttttattcattaaaaagaatttttgcgatctacatcgcaaaatgcttttaaattaatcgtttctttccctcgtttttcccatactaggctttcaaataaaaaggaaaaaatatgaatgacattacctacacattactccgtttaatgcaagtgcctaaacttggcggcgttggcattgataaaattttgtccaatattaccttaaatgaattacttaattatgatgatgttgctttccgacaaatgggatggggagccattcaaattcgccgttggttcaaacctgaagcaaaatttattgagccagcactcgcgtggtcacaaaaagagggaaatcatttagtaaattatttttcccctttttatccctttttattgaaacaaaccgcaaactttccgccactattatttgtaaaaggaaatttaaccgcactttcacaacgccaaatggcaatggttgggagccgttattgcacgacttatggagaatattgggcaaaacattttgcaacagaactttcattagcgggttttaccataacaagcggtttagcattaggaattgatggtcattgtcatcaggctgtcgtcaatattcaagggcaaactattgcggtcttaggcagtggattagaacaaatctatccctctaaacatcaaagattatcagcacaaatcatcgaaaataatggggcattagtctctgaatttttacctaaccaagcacctattgctgctaattttccacgccgtaatcggattattagtgggctttcagtcggcacgctcgttgttgaagccaccgaaaaaagtggatcacttattactgcacggtatgcgttggaacaaaaccgagaggtttttgctgtgccaggcaatattcaaaatgaatcaagtcaaggttgtcatcgcctgattaaacaaggcgcaatgttggtagaaaatgcaaaggacattttggaaacgctctaccaacattctatccacagccaaactgaaattgattttgaccagatcgccgtgcctaattacacgccaccacccgatcctcgccgattagtagaagcaccaagccacccgaaactttattcacgtattggctatactcctgtgagcattgatgatttagctgaagaatttaatttaagtgtcgatgttttacttgttcaattgctcgatcttgagctacaagatcttatcataagtgaaaatggcttatataaacgcatttaacgtaaatttttatgctaagatacgcccattcttttttcataaaaggacgattatgttagccattatctcccctgccaaaacccttgattttgaaagtgcggtaaaaaattttcctgtttttcaaccgcactttactgattacagcgaacaacttattgaggtttgtcgtaaactttctccgcaagatctttcatcattaatgtctatcagcgataaattagcagggcttaatgttgcacgttttgctgaatggacaaaaattcacaatgaagacaattctcgccctgcactctttgcatttaaaggcgatgtttatacgggtttagatgctgattccctttcggaagatgatgtcatttttgcacaatcccatttacgtatgctttctgggctttatgggcttttaaaaccacttgatttaatgcaaccttaccgattagaaatggggacaaaattagccaatccgaaaggaaaagatctgtatgccttttggggaaatgtgattacccaagcagttcaacaagctattgatgcacaaggcgataatgtgttagtcaatctagcctctgatgaatattataaatctgttaaagaaaaccaacttaacgccaaaattatcaagccagttttcttagacaataaaaatggaaaatacaaagtaattagcttttatgctaaaaaagcgcgaggattaatgtgccgttatcttattcaaaatcgtttaaccgacattgaacagttaaaagaatttgatttaggtggttattggtttgattcagcatcctccactgaaactgaatttgtctttaagcgagatattaatgaataaaatttttgttattttgaccgcacttatacttcagggctgtgcaactaagctgacccaattaaatgtgcctacgcagttagaatataatggggaaccgaggctgatatncgtaaaaca

SEQ ID NO: 360 - DNA, 2408 bp, H. influenzae
  misc_feature (260)..(260): n = a, c, g, or t
  misc_feature (2356)..(2356): n = a, c, g, or t
gggaacgcagggcagccttacctattgtttaggtagagaaattaggggtacacccgattatgttgatttggcaaaaatgccaccttaattggtagcaggttttacggatccaggtaagtctgttggtggaatccgatgaattcccagtttactttatcggttcacccagaagatgggaaatttattatgattgatcctaaagtcgtcgaacttcgtgttataaataatattccacattgtactgacaccagttgtaacgngtatatgaaaaaaacacgctaatgcgttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatactaatttaaaaggaaagtaaaatgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaataacaagtgattattttaaataagggcgtagaaatacgcccttcaattttgtgagaaataaaaatgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatnctgaacgaggattgggtaaagaggggtaccgagcctgatatccgtataacag

SEQ ID NO: 361 - DNA, 3696 bp, H. influenzae
  misc_feature (1006)..(1006): n = a, c, g, or t
  misc_feature (2037)..(2037): n = a, c, g, or t
tgatttcgtatatcaaactcgtatcccgttttgtttgaattcttcatctacggctttttgatttcttttaactgcggaaatcagcaaaagcttgataataatcgtggtattgcaagccttgtaatagttgatgataacgttgaggttcttctggtgagaatttaccctcaataatttgatccacgactgtgcgtaattgagcatcgttttgatagtattcaaatgaacgatagccgtcgcgacgaagttgttccacttgttctaccgtattaccgaagatgaaaatgtgattttcgcccacattttccaagatctctacgttcgcaccgtcaagtgtaccgagtgtcaatgcgccatttaaggcaaacttcatattactggtgccagaagcctctgtgcctgcaagggatatttgctctgaaatatctgctgctgggatgataagctgtgcaaggctcacgctgtaatttggaataaatacaacttttaaacggcctttcaaacgctcatcattattgatgacattagcaacatcattaattaaatggatcgtttgtttcgcagcatagtaagccgaagccgctttacctgctaaaataaatacgcgaggttgccaatctttttcagggttggcaagcatttcattgtagcgagcaataatatgcaatacgttcaacatttggcgtttatattcgtgaatacgttttacttgcacgtcaaataaggcgtgcggatcaagctctacccctaactcgcgttttacgtattccgctaatttcactttattagcaaatttaatgtcagcaacagcctctttaaatgctttttcttgcgtaaatggtttaagtttttcgatttgacttaaatcacaacgccattctgaaccgatatatttatcaaacaatgcggctaattgtgggttcgccacgggctaaccaacgacgcggtgtgataaccgtttgttacgttggtaaagcgttctgggaaatacgagcaaaatctgcanaggttgaaagttaccattaaatcgaatgaatttcggcaaccccgttgattttgtgtgaacctactacggatagccatcccatacgcactttgcgttggtagccttcttcgataagagaaacacggcggataaaatcgttgtcagtcgttacataagtgcggacatattctaagaagtgatcgttaatttcaaaaatcatctgtaaatgacgtggcaagatttttgccatcatttccacaggccaagtttctaacgcttcggacattaaagtatggcaggtgtaagagaaaatgttacgcgtcatctcccacgcttttttccactcgaaaccttcatcgtccactaaaatacgcattaattcaggaatcgctaacgctgggtgggtatcatttaagtggatcgccactttatccgccaagttttcaaggctgtcgtgggtgcgtttgtgacggcgtaaaatatcttgaagcgatgcagagactaagaaatactcttgacgtaaacgcaattcgcgaccattccaagtagaatcatcagggtaaagtacacgtgataaatttttatttgcggagtgctcttctaatgcggctaaatgttcgccacggttgaagtcggcaaggttaaacacttcgcctgcgtgtgccgaccataaacgtaatgttgctgcagaattattttgataacctgggatcatttgatcgtaagcaagtgcggttactttttcggtatcttgccaaatacattttttgccttcgaaatgaatgtttccaccaaattctacggtaaagcgtttagatggacgaataaattcccaaggtgctcctttttcaagccatgcatcaggacgctcgacttgctgaccattttcaattttttggcggaacataccatattcataacgaataccgtagcccatacccggtaaaccaagggtcgcaatagaatccataaaacaagcggctaaacgacctaaaccaccattgcccaagccaggatctactctttttctaaaactcttctaaatccacatntaattcagaaagtgcttcctgtgctaatccataaatgccttctgcaatcattgcattagatagcgtacgcccgattaaaaattccattgaaaggtagtaaacacggcgagaatcttctgctcgagtttggcgagcagtagtgatccaaccctctgttactaaatcacgcacagcgtgaagtgttgcattgagccaatcgcgttggctggcttcacgtggagagcgaccgattaagaaaataagtttgtaaacgattgattttttaatcgcttcaacggtcatttcaggacgattatattggaatggagaatcaaagttatccattatcataggtaaaacctctattagaatgctaagaaatgattaacgtagggtgtgtgaattttcaaaattcacgcacgtttgcaaaaatcaatcaaaatttgaccgctctttgaatgcgtgaatgttgtttacacagcctacaaagtagttcgaattttatgcttatctttgcaaaaaacaagcacaaccacaccgcttgcaaaatattctttcacaagcggtgtgattgttaagaaagtttacgaataaaactacaagcgttcataaagtgttctatattgctctgcagccttacgccagctgaagtcttgttccattgcatctgtacgaaccatcgcccatgcacgcggtttttgccataaggcaaaggcacgttgcaagcaatggcggagagcttcaggcgttgcactttcaaacacaaaacctgttgcggtgcgagctttgatgctttctgaagtgctatccaccaccgtatccgctaaaccacctgttttacgaacacgtggcagtgtgccatattgcaaaccataaagttgggttaagccacaaggctcgaaacgacttggcactaaaatcacatcgccacctgccaccattaaatgcgaaagggcttcatcgtagccgatttttaccgcaatattttgcggataacgttcagcaagctcacgaataccttgttcaaagtgcggtgcacctgaacctaaaatcatcaactgaccgccttgtttgacgatttcgtctgcactttcgattaataaatcaacacctttttgctcggttaaacgggtaaccatcacaaatgccaaggcagattcatcttgtggcaaattgaaataggcttgcagttcggctttgtttttctttttgcctgccatatatttgagcttgtaatggcgcggaatgtattgatccacgttcggatgccaaatattttcgtccacaccatttaaaatccccaccaaacgacctcgcgcttttaacccagaaagccagcctttgcaaaccgtaggcatattctggcctcttcacttcttctgcataagttgggttaactgccgggctggcatatcattttaacaaccccgctttcttttttgtatcccgcccattaagcctccgcctttcttctgccatcgtccctgttcgatcggccccgcgtttttctttttgttccaccccttgttctttcatcggccggtgagggaatgtttccatccggcttttttggtcgcaccttccgacaaccgatggcgtctatcatacccgctcaactgtccttgacttccatcaacgtcccagccaacaataagtctcttctcgtctccccccccgtcg

SEQ ID NO: 362 - DNA, 2007 bp, H. influenzae
atatcgactcggtacccatctaaaccttgtaaagcaccataatgacgttcatttaaacgccagttttttacttgcggaatccataattgatgggattcttctaacacgatattacaagttttgattgctcgagttaaaacagaggtaaatgcgatatcaaattcataacctttgtctaacagttttttacccgcagcttttgcttcttccacaccacgttcagttaaattcacatcacgccagcctgtgaataagtttttcgcattccattcactaaaaccgtgacggataaatactaattccataagaatctcctaatgttttcaaataaaaagaacgcgcattttatagcaaaaaatccttagctttaaaagttaaaagggatgatttcctgatctttagcaaaaaataaccatcaaactttttcgccttttaacaaatatgataagatttgcgagttttacgaatttaggatgaattatgttgcgttttggcgttaatcaaaaaacatcattattattaaccgcacttttaagctgcggtttattaatattttcgcctgtcagccaatcttccgatctcaatcaaattcaaaaacaaattaagcaacaagaatctaaaatagagaagcaaaaacgtgagcaagctaagttacaagcaaatttaaaaaaacacgagagtaaaattaacagtgttgagggcgaactgcttgaaacagaaataagtttaaaggaaattcgtaagcaaattgccgatgcagataagcaactcaaacaattagaaaaacaggaacgtgagcaaaaagcacgattaaccaaacaaatagatataatttatcgttcaggcattaatccatcgctgattgaacgaatgtttgcccaagatccgacaaaagcagagcgaatgaaagtttattatcagcatttaaatcaagttcggattgaaatgattaataatttaaaagcaacgcaagcacaaattgcagtacaaaaaaaggcgattttctctcaacaaaagaatcaccgaaatcaactttccacacaaaaaaaacaacaacaagcattgcaaaaagcacagcaagagcatcaatctacgctgaatgaactcaataaaaatttagccctagatcaagataaattgaatgcactaaaagcaaacgaacaagcacttcgtcaagaaattcaacgagctgaacaagcagcgcgcgaacaagaaaaacgtgaaagagaggcacttgctcaacgccaaaaagctgaagaaaaacgaacatcaaaaccttatcaaccaactgtacaagaacgccaattacttaatagtacaagcggtttaggggcggcaaaaaaacaatattccttaccagtttctggttcaattttgcatacttttggttctatccaagcaggcgaagtacgttggaaaggtatggtaattggcgcatcagcaggcacgcctgttaaagcaattgctgctggacgcgtcattttagcgggatatttaaatggttatggttatatggttattgttaaacacggcgaaactgatttaagtttatatggcttcaatcaagccgtatcagtgaaagttggtcagcttgtttcagcagggcaggttattgctcaagtaggaaatacaggggaaatatcacgttctgcgctttattttggtattagccgtaaaggaacgccagtaaatcctgcagggtgggttcgttgatgaatattctgataaaaagtgcggtaaaaaatttcattgttttttctaccgcactttatacctctttttcttttgctcaaagtaaacttgctattgtgattgatgatgtaggctatcattccaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgc

SEQ ID NO: 363 - DNA, 2564 bp, H. influenzae
gactaaataaaataatcaaatctagaaaaaagaaaaaagagtaaacaataaatatggcgaaggatgagttgtagatagaagaaacaacataaataaaaagaataatgagaaaacaagaaaagagaatagagaaagcggaaacaacagagttagaccgcagcagcaagaagaataataagaactgatgcatgagatgaaagaacaaaacaaatggagagtaataggagataaaatggcgctgcgagaagagattacagaaaaacaagagaaagagaagagggaaagataagctagaagatgcaataaaaagaaaacatgagagtaaaatgtataggagaacgaaggaaaaaagtgaagaaaggagaaacaaaagagaaagaagtatgagacggggaggagggagagacaggaaggagaaagaaagggggaaggaagggaggtaaggataagagagaagaaaggagaatgaaaaagattggacagtacagacggaaaagggagaggggagtgtgggttggggggggaacaaaatgggggagagaatgaggggaataaacaaaaggcggagattcggagggtaggggatagtcgggcttatttaattgatgagaaaggaagatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgagtaaaaaatatgtttaaattgttttttttttgctcaattatctataattcggtgaattttaactagaaataaggaaaaactatgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttcttaaaactatccttaacgacaccttttgtcgcactactcactaaaatactccttaccaacccagtaaggagtattttttatgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaatgataaaaatttacgcacggttgctcgtcggcttttaaaagagcggtataaaaaactccaaaaatccaccgcacttttacctgagttatggaaacaggcgtatgaaaatttggcaacgttggcagaatttttgcaactgaatcccgttgaacaggaacttctccgctttgccatgcatttacgtagtgaaggagctatgcgagatttgtttggctacttgccgaaatcggatttacaaagaacggctgcgatcatggcggatttacttaaacaggggtaccgagtccgaatcgtataca

SEQ ID NO: 364 - DNA, 2810 bp, H. influenzae
tttatacgatatcggctcggtacccttttttagtaacttgcaactattttatggtctggtcgcaccacaaaataggcaatggtgaacacacacatcaaatatagttacgtacctttgcatacgctcaaggcgtaaccaagttacattgcgagcgggattttagcattatctaaaatctttggctatgattttattgcttagaacccccccccccataaatcaatgtcaaagtttagcttaagtataagccaccattcacgtgtaacgttgtacccgtgatataacctgcatcatcagaagctaagaaagcaacggctttagctatgtcttttgcttcgcctaaacgtccagctggaacattagataagatccccgctttttgttcatccgtaagcacttctgtcatatctgttgcaataaaacctggtgcaaccacatttacagtaacaccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacacagaagttaagttagtttgcataatatcaaaccattcctcatctttcatacgcatcaataaattatcgcgagtaatacctgcgttattcacgagaatatcaatatcgccaaaatcatttttaatttgctcaagtaaagtttcgatagattctttatccgttacgtttaaaactaaacctttacctttatcccctaaataagccgagatcgcctctgcacccttttcagaggttgcggtaccaattacaaatgcaccttttgaactaagttcttctgcaatcgcacgaccgataccacggctagcccctgtcactaaagcaattttaccttgcattttttcttccttttacttacgctaaaaattcttctaccgcattgaatgatgcaacatcatttacagatattgcttgtaaatcacccacaatgcgtttgggtaaaccatttaatactttacctggccccacttcaacaagcgctaaaacaccatcttgcgccattttttcaactgtttcagtccaacgaactggactatataactgacgaacaagtgcggtacgactatttcggtgccttcagtttcagctttcacaatcaacgttatttaataaccgatattgttggtgtattatatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacaccccagcacaaaccaaggcagaatactcacccaagctatggcctgccatcacttctggttttaattgaggaaatttttcttgccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagtggcaagatcagcaagcataccgacagtttgggagccttgacctgggaagaccattgcgaattttttcattatgttttgtcctattgttttttaattgaaaattcttcttcggtaattaaaatcgggtttcgccgatggcgacttactttttctttgcttcgccaaagaaaaagtaagcaaaaagaagggaacccaatttgttctttatccgatttaaagtgcggtcaaaactcaaaatattttttgttcttaaaatgaatttaaaattaaccgcactttttaaataatgctctgataaattcggggccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacgaccatctcgaatagcctcatctaaagcgacaggaacagttgctgcactgttgttagcgtatttatctaacgttaccaccacttgcgacatatccatttctaattttttagctgttgctgtaataatacgtaaatttgcttggtgtggcacaagccagtctaaatcttttttatctaaattatttgctaaaagtgtttcttccaccacatttgaaagttcacgaactgccaatttgaacgtttcgttaccttgcatctcgatatagccagatttttctataccacgttctggctgagctaaaacaagggg

SEQ ID NO: 365 - DNA, 2023 bp, H. influenzae
tctattgatataaaagacaacaaaattctagtgtggttgatcaagggatttcttatcttaatttgatgcttgaatataaagctgattttattgtggaatataatgaaaagcaaaaagccccacttaaaagaaatgatgtggattggtcacaatctaaggtgatttttgtttcacctacttttaatgatttccaaattcaagccacaaattttaaagatttacctattgaattatgggaagttaatcgctttgataatgatattattacgctcaatattattaataaatcaaaatcagcaccgaatattaaagctgtttctattgaaaaaaatgaagaattttctacattaaaagaaataaaagtttatcaagaatctgatcacttaagtgataaatcagattttattcaagaactatacgaagattttaaacaaggcattttaaatttagatcctaatatcgaaattaatactagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagctattaaggattaataaatgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggcttagagtttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttattttgtttattaactaagccaactcaagggcaaagtgcggtcaattttaaaggtgttttaggattaatcggcgtctggtttggttacggcatcattgatattttattcaaacaagtagcgaaaagcggtggtgcatttcctgcaacattgtttatttctttctcgcttgcagcttgcgttatgtttatctatttattcttaaaacgtgcgcaatggacatcatcaagtgtaattggcggcatcgttttaggtgtattgaatttctttaatattttattctatataaaagcacatcaaagttttgctggaaatccgacgcttgttttcgcgggaatgaatatcggggtaatttgcctaggtacgataactggcgcattagtttttaaagaaaaaatcagtaagctaaattggctaggtattatttttagtttatcggctattttctgcctatattatttagacaaactcatcccgtacaagagagtagtcatggcaaaagacttcagcttttttatttacgattatgcacagtttttcgttaatcccgccatacatcgccctctccaatttgttgtcgttctcacgcacgctcactcaccacttccgtccacccccttacttccctttttctaatttatcccctatcctctccccgctctctatccccctcaggtacctctcctccctcctcccccctctcttcactcaatattcccccccctctctctcccattctctcatcccctctttacttttcatccctcctttccctatttttccccctatctcatcacttttcacactattatcttttcctttccccgtattctttccttttactccctttccatctcttcacccctcctcctttccctcttttttccatttttcctcttcgcctaccgcccttg

SEQ ID NO: 366 - DNA, 2360 bp, H. influenzae
ataaagaaatttgcagatacatggcgatccaatgattcgatttccccatgtctgacaatctaaacaatatcaaagtgcggaatgatttcagccagtttttcttcgtccaacttcgcattaatcgtctctatgtttatatgtggattgatttgttccagtgcaattttagcggattccacctttggcatattcaagcgcgtatcgcagtgtaggacttgtcgttgaagattcgaaagcgaaactgtatcgaaatccaacagtgttaaatttccaacgcctgccgctgcgagatattggctggctgcacatcctaagccaccaagcccaacgatcagcattttgcttgctttaagtttttcttgcccgtcaaaatctacgcttttaagaataatttgacggttataacgcaattcttcttcgtgactaagttcgatcattttttatcctaataaatgattgaaaggctcaattgtcactgtttcgcccgcagagacattgccacgttcttgttctaacacgataaaacaattgctttttacaaaagcactaaagagatgagaaccttggaaacctactgattgcacttcaatttgaccttgttcattgatgtaataaaaaccccgttggaagtctaaacgtcccactgcttttttcaaattcattgtagcaatggctgaaaagtgcggtggatttttccattgtttttgtccttgcagtttagcgattaatggctgtacaagttgatagaatgttactaatgcggaaacaggattgccgggtaaaccacagaaccaagcattttctaatttaccaaaagcgaatggtttgccgggtttgattgcaattttccagaaatttactttgcctactttttccaatactgctttagtgaaatccgcttcaccaacggaaacaccgccactggtaatcactaaatcggcttggctttgtgcggcaataaatgctttttcaaattcagcttcgttatcaggtaatagtcctaaatcaatgacttcacagtttagtttttctagcagtaattttacggtgaaacggttagtgtcatatatttgtccgctttgtaatggcttgccgacttccacaagttcatcgccagttgagagtacaccgacttttaattgacgatagcattttacttctgcaatgcctagagaggctaataatggcaaggaaactggggtgagcggtgcgccttgttctaatacaacatcccctttttttacatcttcaccaatacgacggatgttttgatttggtttaggtaattcactaaaagtgatggtgccgtcttcattgagtgttacttgctcttgcattatcactgcatctgtgccttcaggaatcatcgcgccagtcataattctgaccgcactttttgatggccattcctctttgaatggattacctgcaaaagatttccctgccactgaaagggttaaagattgttgtaaatccgataaacgtacagcataaccatccattgctgagttatcgaaagagggaacattgataggcgaaataatatcttctgcacaaattcgattggcggcttcttgtaaatttaggtattcagtttgagtcgggaagggaagctgttcaagcattttcgagcgagcttgatccaatgtaagcatagaaaatccttatttgataaaatttgtcagctattctatatctaaagcctaattcattcaaatttgcaatttttctcatttttaccatcctattatcctttgctagaatagccgattatttttttaggaaagacctattatgagcaaaatttcactggatgcactgaatgtaacaaatgccttgattgaaaaaggttttgatacacctatgattgatccaacacaggctatagatgaatctttagatatctttgcgaactccatgtctgaagcattgatgctgatgggcttaaacttgtcaatatgattgtctaatattaactcccttatctgctatctaaaattgttatttgatcacaatctttagtggacaggatttatgccatttttcctaacttgactaaatacacatatctgattatgtccccctaaagcgggccagtcgattaccttcctcttacacgtcctcggggaccttctttccgtgttaattgatgtattgttatgtgtacggttttattcttcgcatttgggtatgtgcttttttatctactcatgcgcccttcttttgcctctctcctcgtcttagtactctctactaaccacttctgatatatagagaccttcttttctacgcggattggcggtctatcttcccgacttctctcctcttcgtatagcctcgccacgtagttcctacctcga

SEQ ID NO: 367 - DNA, 2721 bp, H. influenzae
  misc_feature (2694)..(2694): n = a, c, g, or t
aagggcaaagtcctaagaattttaccaatacaaaattgttaattaatgcggtgccgataatcaataaaatatagtgcgtcattatttttttgccttttgaataggggcgttattatccctatttatggaagcaagaacaatagaaaattttgctaaggggaaatggtaagttgcgattttgttattgaaataaaaaacgcagctaatcatttaaacgattagctgcgtaatatttggattaacaatactcaacttgatttatgaattaaatataataaaacccctaaagatcggcgagtatcttaatgacaaagatttgtcttgtaaacatagaaataaaaacttctttttttgtggataaatgtttagtacataaagtctctagactgttttgtactataacgatgaatgatattaattgcactttcttcagcttgtcgtccgaatttttttattagggatttttttaaacggtatttaacattaagtacctgtttttctttcattttttccaaaattaaatcatcactcgttgagatttcatctacaagttgtaatgcaatggcttgttgtccaaaccaatgttcgcctgttgcgattttatcaatatctaggcaagggcgattttgtgagacaaattgtttgaataatttatgtgtttcttccaattcttgttgaaatttttgtttgcctttttcagtgttctcacccaatacggtcactgtacgtttaaattcgcccgcagtcattacatctacatcgacatcgtgttttttcaatagtcgatgaacatttggaatttgagcgacaacgccaatagaaccaataacagcaaaaggtgcggatacaattttatcggcaacgcaagccatcatataaccgccacttgcagccactttatcgacggcaacagttaattttatgcctttttgttttaagcgagacaattgagaggctgcaaatccataattatgcacaataccgcctgggctttctaaacgtagtaatacttcgtcttctggttttgctacatttaaaattgctgaaatttcttcacgaagtgcggttgtttctgaggctgaaatatcgccgcaaaaatctaatacatatacgcaagctttcttttcatcttctaaagtatcgccttttttcaatttttctttgcgttttttagcattttgtttttctgcttttttttcagctttagtgcgttgtttttgttcttcttcagaaagattaaaatcacgtaataaacgaacttgttcattaaattcttctgataaatctttaatttctaattctcccactttagacttgttatgttggcgataagaaataatcaaaccaacaatagcaagaatgagtaataaaattgttaaaatttccagaataaaaattccatagcctgttaaaatatcgttcaacattgttactcccgttgatatttaatggattaaattttcacgacactggtttagtgtgtagatcgccaacataataaaacattgtgattgtttgtgctatttataacaaaaaattttaaattaattcttactttttattttcattttggctaatttggcatagcataagcgagtatttcatttatatcaaaggagcaattatgaaattacgcgctgttgtattaggtcttgccacattatgcacaagtacggcaacctttgctggaatgggtttccacttcatctaaccttgagtttttagcgattgatggtcaaaaagcctctaaatctctcggaaaagctaagccatttactgtagatgatacccaaagccatcaggttggtgtgcgtttaaatgaaattgttggttcaggatcgaatcaatctctttttgaatctaatcctgtgattgtgacattcaaaggtaatgctgaagatttagttatttccgccccagctattcgtaatcttgatagtggcgataaattcaatcaaatgccaaatattactgtgaaaacaaaatcaggtaatgctatttcagcgaaagtggatgtgttaaaacaagaaggtttattcccaagtggtaatgtgctaaatgatcttgctgaatataatgcgtctggtgcagcggcatcagtttctaaatttactgcaacaacttctgctaattcaatggttgctgtgccagcaggtaatgcaaaagcgaataaaggcaaagtggttgttcagggcgaaaacgttgcagagcaacaacttcaatattggttccaacaagcggataaagaaactcaaacacgttttttaaactgggcaaaatcccataaataatgaccgcactttatacaataaaaagtgagccttgttgctcacttttctattttgataaggatttgaaatgaatattcggttaaatgctaaagtaatttctacaattcctgtttttattgccgtaaatattgcggcagtgggaatatggttttttgatatttcttcgcaatcaatgcctttgattctagggattattgcaggtggtttggtggatttggataaccgtttaactggacgattgaaaaacgtattttttacccttattgccttttctatttcttcctttattgtgcagttacatattggcaagcctatccaatatattgtgttaatgacggtgctgacatttattttcactaatgattggtgccgtggggcagcgttatagcaccatgcttcggtnctgggtaccgagtcgatatcgtataca

SEQ ID NO: 368 - DNA, 2013 bp, H. influenzae
gcgttaagtatctcaatatcttcccctattcgccaaatcttttataggctacccctgttttccaagcccgctcccccttaggcaaagtttccttcaaaacgagcagttacatcttcttttacaatatcatcgttctgctcggtgatattgtcgtcaaatttcaggcgtttcagcgtgccatcttcgattaatacgaatttaaggttgttttcccactcaagcgcgagtttagagatcaagccattttgaacaagctcaataatttcctcgtcttcaacatctttttgcttgcagtgaataacgccaagatcttctttttcgcggatttccacttccttacgcaagattagccaatcaggtgcagtatctgtaacccatcttgtcattacttcacacggcgcacagttaaacgccaacggtactactagcaaactacctagcgatttgcgcaaaagtgcgagtgcatcctcagctgttttacttgatgctgcatcaacaaagataagttgtttcaacgtgtcgatgtaaagtgcggtcgttttgatgcgagaaaatgcttgcggaagtagagtagctatcacgtcatcttttaaagatgatcgttctactttctttaattttcgctgttctttttcttcaagtgcagtgattcgtttattgagttcacgattcacaacttccacaggcaaaatcttctcttctcgtttagctacaagtaagatttttccgttcgcttgatgtgctaaattttcgctggtgacgagcggagcagaccaaccgaaatggctaacatctgctgaaccacacggagtaaattcacattctttgagttgtttttcgatattctcaaagtctatttgttttgttaattggtaaataattgcatttctgaaccagtacatttttattattcctcataaataaaaagccgctaattaatagcggcagattttaagcatcatcttcgtagtagtgttcttcaaccacgaatctatcactaccatagacaggttctctatatggtttttagtcatctttaacctcaacaaactcaccaaattcatctaacgtgtaccaagtatcagctttgatgttattttcaccgacttttgatgctttgatatggattagctcgccatcatgattgcgatatacacaaacaatagcaccattaatactcgccttagctttagattgccaaccaagcgcaacagctatagattgcttgccagatatttccgctaccgactgatcgcctgtattagtcgctaccgaccgatagcctgtattagtcgctgccgaccgatcgcctgtattagtcgctaccgaccgatagcctgtattagtcgctgccgaccgatagcctgtattagtcgctgccgaccgatcgcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattggttgctgccgaccaatcgcctgggtaccgagtccgaatcgtatacca

SEQ ID NO: 369 - DNA, 2813 bp, H. influenzae
atgttaaacgaatatcggactcggtaccccttggtgggcggcgttgcatggttataatcatcctcgtttaaatgcggcggcacagaatcaattagcaaaaatgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacattaggataaaaaatggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgcttataaggaaataatgtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagttcttttgaacgttatcaacaattttctgcacgaccatttaacaaaattcatcaagaactcaccgcacttttgcgatgatgggtaccgagtccgatattcgtataccag

SEQ ID NO: 370 - DNA, 3194 bp, H. influenzae
ttgctgtattgtttttagctaccacgccattaattgcggaagataatctaagtgcgggttcttttacggtagttttttcatctatgttggcaatgatgcgcccattaaaatccttaacgaatgtaaactctcaattccaacgtggaatggcagcatgtcaaacgctatttgccattttagatttagaaccagaaaaagataacggcacttataaagcagaacctgcgaaaggtgcgttagaatttaaaaatgtgagttttgcatatcagggaaaagaggaacttgcattaaataatatttcttttagcgtgcctgcaggaaaaaccgttgctttagtgggacgttctggatcgggcaaatcaaccattgctaatttagtgacacgtttttacgatattgagcaaggcgagattttactggatggcgtaaatatccaagattatcgtttatctaatttgcgtgagaactgtgctgtggtttctcaacaagttcatttatttaacgataccattgcgaataatattgcttatgccgcgcaggataagtattctcgcgaagaaattattgctgcagcaaaagcggcttatgctttagagtttatcgaaaaattaccgcaaggttttgatacggtaattggcgaaaatggtgcgagcctatctggtgggcaacgccagcgtttagcgattgctcgcgctttattgcgtaattcgccagtattaattttagatgaagctacatctgcactagatacggaatcagaacgcgccattcaatctgcattagatgaattgaagaaagatcgtactgttatcgtaatcgcccatcgtttatcaaccattgaaaatgcggatgaaattcttgtgattgatcacggagaaattcgtgagcgaggcaaccataaagcattgcttgaacaaaatggtgcttataaacagctatacagtatgcagtttagtggctaatttattaattattgaaaacgcgagttgaaaaactcgcgttattttatccgcacttattagaaaggattttctatgcccttctggtattccaattccaaacttatttggctcttatcgcctttttctttattgttttggttgattagccaactgcgtcacgccttattttgtttggggataaaatcttcttatcgcgcaccaaaaccagtgataattgtgggaaatttgtctgttggtggaaatggcaaaacgcccgtggtggtgtggcttgtggaagaattaaaaaaacgaggtttgcgcgtaggtgtgatttctcgtggttacggcagtaaatctaaaacttatccgttattcgtcactgaaaatacgcgtccgattgaaggtggcgatgagccagtattgatcgctaaacgcaccaatgcgccagtcgtgatttccccgaatcgccagcaagcgattgaattactcttaagccaagcagagtgcgatattattgtttctgacgatggtttacagcattataaattacagcgtgatttggaaattgtcgtaatggacgctgagcgcgcattgggaaatggttttgtattgcctgcaggcccattgcgtgaattaccaagtcgattaaaatccgtagattttgtgatcactaatggtggaaaaaatcagtattcagatgcagttatgtatcttgtaccccatttcgcaattaatttaaaaaccaatgaaaaacgccaattaaaggaatttcaatctggtgttgccattgcagggattggcaatccacagcgtttttttactatgttagaaaagttagggattcaattagaacgaactcaagcatttcaagatcatcaacattttgaagcctctcaattagaaaaacttgctgaaaatcaaccgctctttatgacggaaaaagatgccgtaaaatgccaatcttttgccaacgataattggtggtatgtccctgtagatgcagagattattgaggctgaaaaacaatgtgaaaatttaccgcacttttgggacaaaatagacaaacttgtggcgcaatatagaaatggctgaaaggatttatctccagttgttttgattgcttaccgagaaagctgaaatattaaagaataaggaataaattatgtcatttaccgttattatccccgctcgttttgcatcaagtcgtttacctggaaaaccgcttgccgatattgcaggtaagccaatgattcaacatgtatttgagaaagcgctgcagtctggggcgaaccgagtgattattgccaccgataatgaaaatgtggctgatgttgccaaaaattttggcgcggaagtgtgcatgacttcggttaatcataattctggtacagaacgtttagcggaagttgtagaaaaattagcgattcctgacaatgaaatcattgtcaatattcaaggcgatgagcctttgattcctcccgttatcgtgcgacaagtggcagataatttagcaaaatttaatgtcaatatggcaagtcttgcggtaaaaattcatgatgctgaggaattattcaatccaaatgcagtgaaagttttgacggataaagacggctatgtgctatatttttcccgttcggttattccttacgatcgtgatcagtttatgaatttacaggatgttcagaaagtacagcttgcggacgcttacttacgtcatattggcatttacgcatatcgtgcggggttcataaaacaatatgtgcaatgggctccgactcaacttgaaaatctagaaaaacttgagcagcttcgtgtgttatataacggcgaacgcattcacgtagagcttgcgaaagaagtgcctgcagtgggggtggatactgctgaagatttggaaaaagtgcgggcaattttagcggcgaattaaaatgtttgatgctaaaaagttcttagcggatgtctctcacgaacctggtgtttatcgtatgtatgacgataaagatcaggttatttatgttgggaaagcaaaggatctaaaaaaacgtctttcaagctattttcgtaaaaatctgagtagtaaaaaaacagaggcgttggtagcatcaattcatcatattgacaccatgctaacttcatctgaaacgggagcctttactgcttagagcattattttattaaggctttatcagcctcgctataacgtattattgcggggagataaacctatccatttttttattaaccacaaacgcc

SEQ ID NO: 371 - DNA, 2525 bp, H. influenzae
cagaaaacccatttcatcgcacttaagccaacaattaaaactgcgcaacccccaaatcaataccaattgcagagaattttgcaattaacgcgactaaaggatttttttgtttgccacgttgataacgccagctaataaaaaacggcgtattcatcacgccccctccttcaaaagaccatcttgcataactaaacggcgtgataatttttccgcaagccccatatcgtgagtgactaataaaaaggcgatattttgttcttgattaagttgttgaatcagctcaaaaatactttcagtggtcttgtgatcgagatttcctgtgggttcatccgctaaaactaacgatggattattcactaaagcacgcgcaatcgccacacgctgacgttccccaccagaaagcgcagaaggacgatgggtaattctatggcttaatcccaccgcacttagcattttttcagcgcgatctttcgcttcagttttattttgatgaccaatcaacatcggcatcatcacattttcaagtgcggtaaaatccgccattaaatgatggaattggtacacaaatcctaaataacgattacgcaaagcagctaattcattagccgatgctttttgcaaggattgtccattaataaacacttccccactacttggctgatcaagtccccctaaagtatgtaataaagtacttttccctgaacctgaactccccacaatcgcaaccaactctgcaggttccatagaaaaagaaacgccttttaacacttgcgtttgattttcgccctcttgataaaatttattgatattttcgcattttaataaatagttgttcattttttactcgttttaaccgcactttagcggcagataatcccatcaaaaacttgcgcgagtctatcacacttttccttgagcttaaatttcaatacacccaaagtattcaaatcctgtttcaggaaaatgtttttcaagataacgttttaaatagcgttgggtttcttgactaataataggatcatattctgggtaaccgttatacattacacttaatactgaaatacctcgagtacgacaagcctctaaacttaataatgtatggtttatactgcctagttttcccgatgtccactaaaattaaagggtaattatttaactggatataatccaacgtcgtctcttcttcacaataaggtaccattaagccaccaggcaccctccaatagtacataatcatatttttctgccaaagtgcggaagatttttcaaggatttttgcttcaatttttttacttttctcgctttgcagctaaatgtggcgaacaaggatattcaaaaacataagggcaggttttgccttgtaaatcttcttccgttaaatcaatgtcttgaatctttcgatgcacaagtaaatcatcagcgatatttttacagcctgtttgaatcattttttgtgtaatcacggagcagccttgttccatcaattttttagcataaatgcctgtggcaatcgtttttcccacatcagtatcaatgccagatataaaaataaccttgcccataaatattccttactgattttctatgtgagaatagcgtgcgataaaaaataacggatgataagtcaggcgcactttgtccgacggcatactgaacgccgacaagtaatcgccaataaatccattgagattttttcttgtccaatttttttggttagtcgctgttacaccggtatatttcagatgtttgagtacatccaatggtgtatcaaagtctagtattacattaaaatcctcacaccataaaagctcaaaatcattggctaaccaattttgccattgggataaagtcgggtaatttaatcctatatttgtgatctggcggacttctttcaaattgtcttcgccaaaggttgcaaccgccaataatccgtttgttttcaagcctgttttgcaatgggcgataaaagcgtcgggttggtgaaaccattgcacggcggatgcacttgcaatcaagtcaaatcgtcgttgaaaaggaaagttctctgcatcaccacaataaaaatcaaagggttgaatcagcttttcagtgagtagagtgcgcacatcgcacaaatcattaaataaccaatagttggctgaaatctgtttctgcaacaacgtactcaacataccagacccgcaacctagttccaaaacgctatctaatgacccatttggtaaatagtcttgcaaatgcatcattaacttaatattcattttttgttgaattaacgcatgttcatcatagctatttaaggctttttggaaggcttgttgaatacgcgatttatttacggaagttaatgattccataatgccgaccagtgggtaaatcttgaaaacacataatgctcaccctctattttctgaacggcacaacgggatgcccaatattggttctgattggctggcgtaaaaattttatcgcgagaactaaccggggatccttctagaagacgacctgcagggcatgcaagtcatggc

SEQ ID NO: 372 - DNA, 3233 bp, H. influenzae
ttcttggaaaaattttcaagagcaactcaatcaactttctcgagcattgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagcataaccaaaaggctctcaattgagagcctttcttttctaattattcaggaaacttttcttctaaaatcaatgcaagtccatcttcattattggttgccgtaatcacatttgccgcttgtttaatttcatctggcgcatttcccattgccaccccaagtcctgcgtgttgtagcatatccaaatcattaaaattatcgccaaatgcaatcacttcattgggtttgtacgccaaaataatcttccaaaaaacgcaccgcacttcctttggttgcattcttgtgcattacctctaaaaaattagcgtgggaacggcaaatacttaaatgtggaaattttttctttaaaagaacttcaatctcaatgatttcttctgcttccccaataatttgaattttatgtggcgaacttgtcgctacttcatcaaaaggatgaatctcaattttggtcacgctgcattcataaatcacccatttattttctacgtcacgagcatggcaatcattatttgtataataattcacgccaagcaaaggatgttccgccaaaacggtattaatctctaaaatatcttttggatcgatttgtacgctataaattggttcgagattttggttcaaaataagcgcgccactaaatgcaacaagcacattattcgtttcaagctgtttccaataaggcaaaatacctagaggagaacgcgccgaaattggcacaaaaggaatgccattcgccgttaaacgcttaattaccgcaacagttcgaggggaaatggtatgttgagaggttaataaggtgccatcaaaatcactaaatactgctttatacatcattactccgaataaagattatttctctgctaaataaggatcatcaaagcctaatccttgcataatttgggtttctaaactttccatttcttccgcttcatcgtcttcaatatgatcataaccgagtaaatgtaaacaaccatgcacgaccatatgcgcccaatgcgccattaatggtttctcttgttctgcagcttctcgctccacgacttgacgacaaataacgagatcccctaacaatggcaactccacctcatcggggcattcaaatggaaatgaaagcacgttagtcgggcgatcctttccacgataagttaaatttaattcatggctttcggcttcatccacaatacgcaccgtcatttcgacttcattcccttctggttgaacagcacctgttgcccactgcaatatctgctcttctgtcggcaaaccctttatatttttctgtggcaatttgcatactatccaatactcttcccattctactttcctaaatgtttttatactccaaccgcattttccgccttattgaattcttataccaatgggctgcgcttatgaccattttttcttggtataatatcgaggggaatatatcatactaactctccaatccccctaattagattacttatttatttcttccgctcctccactttatttttactctcctatatactattccccgtatccccttattaatccaaaccc

SEQ ID NO: 373 - DNA, 1854 bp, H. influenzae
ttcaacgtttaaaagaccaaatgcttcagtgaaagagggcataaacccgtcgaaaaattattattgagctgttctgaccgcacatcaaacagaaacaacacgtcgttcattaattcataaacacattgaaatcaataaatgttaagcaagctagaacatcatgatttaacggaaaaagaacgcaattatattgaacgtctattacttcgtttaatcgctgaagcatggcataccaacgaaattcgtactgttcgcccaacgccatttgatgaggctaaatggggctttgcgatgttagaaaacagtttgtggcaagctgtgccagaatttttacgccaactcaacgaaaccgcccgtgaatttttaggttacgatttgccggtaggattaaaacctgtgcgtatttcctcttggatgggcggcgaccgtgatggaaatccatttgttaccgcacaaattaccaaaaaagtactttattttgcccgctggaaagcggcggatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggagccgctttacgattgttatcaatctttaattcaatgtggtatgcgcattattgcaaatggttcattgttggatattttgcaccgtattagttgttttggtgtgacgctttctcaaatggatattcgccaagaaagcactcgtcacaccgatgccattgctgaaatcatgcgctatattggtttgggcgattactctcaatggatggaagacgataaacaggctttcttaattcgtgaattaagctctcgccgtccattgattccgcaaaactggacgccatcgcctgaaaccaaagaaattttagatacttgtaaagtcattgctcaacaaaaacaaggtgtcattgcgtgttatgttatttcgatggcgcgcagtgcatctgatgttttagccgttcatttactcttaaaagaagctggcgtgccatatcatattcctgttgtgccattattcgaaaccttagaggatttagatgcagccgaaaaagtgatgactcaacttttcaatgtgggttggtatcgtggcgtgatcaataatcgtcaaatggtaatgattggctattcagattcggcaaaagatgcgggaatgatggctgcttcttgggcgcaataccgtgcgcaagaagccttagtaaatttaacagaaaaacttggcattgaactcactttattccacggacgtggtggcacaattggtcgtggcggtgcgccagcacatgcggcattactttctcagccacctcgttcattaaaaaatggtttacgtgtaacagaacaaggcgaaatgattcgtttcaaactgggtttacccgcagtagcagtagaaacctttgatctctacgccagcgccattttagaagcaaatcttttaccaccaccagaaccgaaaccagaatggcgtactataatggacgagctttccacgatttcttgcgatatttatcgtggtgtggtgcgtggcgataaagattttgtgccttatttccgcagtgcgacgccagaacaggaactctccaaattgccgcttggctctcgccctgcaaaacgcaatccaaatggcggtgtggaaagtttacgtgcgatcccgtggatttttgctgggggtaccgagtccgaattcgataac

SEQ ID NO: 374 - DNA, 2401 bp, H. influenzae
aacatccattggtgtaataatatcttcaaggcgttgttctagcgcatttactgtaccgattacatcaaattcttggcgagaacaggttgggcaagcaataaagttaattcctcttgaacgaatccgtaaagatttcaaaatatcaaaaccgactttgatttcctctatgggatctgccgccaaagagatgcgcagtgtatcaccaatgccctcagctaataacattcctaaacccaccgcagattttactgcgccagcgcgtgcgccacctgcttctgtaatgcctaaatgtaaaggctgtttaattgctttagccagtaaacgataagattcaaccgctaagaatacatcggaggcttttacgctcactttaaactgatcgaagttaagacgatctagaatttctacatgacgcaatgcggattctaacaaggcttctggcgttggttcgccatatttttcttgcaaatctttttctaaagagcctgcatttacaccaatacgaatcggaatatttttgtcttgcgcacaatcaacaacggcacggacgcgatcttcacgaccaatgttgccaggattgatacgtaaacaatccactccatattctgcgacttttaacgcaatacgatagtcaaaatgaatatctgctacgagcgggacattcacttgttgtttaatttgtttaaatgcttccgcagcatccattgttggaacagatacacgaacaatatctgcaccaacacgttctaatgatttaatttgagcaactgtcgcttccacatcagtggtgcgagtatttgtcattgattgcacggcaatcggtgcatccccaccaattggtacatttcccacataaatttttgtcgattcacgacgcttaatagttggctgaaaagctgacattatttttcctaaggttgtgaaagcttgaattttgctacgcgaccatccactttgagaggataattctcgcctttgtaagtgatacgcacattgcttggtgcgcctacaattaatgaaaattcattgccattaaaggttaatatttcgccttgtttatattctttttgtgctaatacgtggcgagcgttatcttttacactaatccaactgctatttgctagtatttcaatcactaaatcgccttttgctataggtaacgttggagaaatacttggattttcgcccgcactttgaatgtctgaaactgatttttcatcgtttttgggttgtgaaacgctattttcttgtgctatttctggtaacagattatttgttatttctactggttgtgagactggtgctgctgtttctggtgcagatttattagtttcttctgttgtcacaagagcggtggtgggctgattgttttcggtagaggcaacatagctttgcactaaatcatcgcgttcttgagtattttgttgataactttgccaccaccaaagcccagtcataccaattaccatcacgaatactattgcggttaaacgcccgatccaacgattgtgagaagaatattgattaacggcacgggttgaacgtgcatttttccctaaatcatttttttcggtttcagcaaaaacaatattttcccacacagaatctggcaaacgtaagaattttgcatagctgcgaacataacctttgacaaatatagaaggcgttgatttttgaataaattcattattttcaagttgctctaatatagaagggcgtagcgtgatttctttagcgacatcttcaagagaaagatttaaggcttcgcgtgtttgacgaaaaatctcaccaggagaaagcacttgctcagtagttggattcataaagttaatcaaataattaggcggtaaataagggctaaattttaaagtccaatacttgatttggcaatgctttattttagactattgaatttttccgcacgttttccattgatttgacgtaatttttctaatgtttgctgataaatatccatttttttcgcggaataagcacaaagcgcgatattttcaaatgtatctgcttgatgataataattcggcgaattaagggctaattcaaattgttgctgggcttgctcaaatttcttttgactacatagaaacgtaccaaaattattatgtacatcgccttgtttatgattaagttttacggctatttcatactcacgaaaggcattttctatttgcccttgttgttgataataatgcgcaagtgctgaatgtccgagatagtattttttatcgtgctgaagggctttgcctaatttgattttagccagtggggattatttctgtgcaaatgcctcaagcgagtttccccttctctttgtcgtatgttggatacctaatctctaccccctttttcaacccctttggtatttctccccgtcacacttctg

SEQ ID NO: 375 - DNA, 2209 bp, H. influenzae
  misc_feature (139)..(139): n = a, c, g, or t
ccgccttcaaagtcaaaatgactttcgacaatccaatgaggatttaacgcaatttttgcttgcgacagcgcatttttataaccttgcaaacgattttgtgcgacagattttttgagatttcccgtaataatgccaattntacgatgtcctgcatcaattaatgcttttgtcgccaaatagccaccaagtgctgaattttcgagtattttatctgcatttaactcagtaaaccaccagtccatcacaaccagtggcagcgaaatggctaactctatatcagcctgaaaacggctatcaccacacatcaaaagcaaaccatccacttgtttgtgcattagagtttgcagattttgttgtaggcgtttggcatctccacccgttgtagcaataataagattatattgatttttctgacaatattgctccacgccagccatcacttccgcaaagaagggattatttgttgcggtgacaagtagcccgatagttttggtttcgcgcaccttaaggcttcgtgcaacagctgaaggggtgtaattcagttcagcgacaatacgcatcactttctcacgaatttcatcgctaacaaaacgcgatccattaatgacatgtgaaactgtagaagtcgaaacttgcgccagtcgtgcaatatctttcattgtcgccataaaaacaccctaaaaattcaccgcactttaagcgtgttcaagaaattccaaagtttcttgacgcgttggaatagaggattgagccccttttttcgtcacactaatcgcagcggcagcttgaccaaaacgaatggcttcatcaaaggatttttcttccaataaagccgtaacaaaaccgccattaaatgtatcaccagctgcggtagtatctattgcttgcacacaaaagcccttaatgatgcggcttttaccttttcgactgacaaacacacctttcgcgccaagggtaatcattacggtttcaatgcctttatcgtgaaaaacactcgcagctttcaccgcactttgctcgtcggctaccgctacccccgtcaggatttcagcttctgtttcatttggtgtaataatatcaatcaaactcaataattcgtccgataaaatctgcgctggagcaggatttagcacaaccttaacaccatttttcttagcgatttgagcagccagctccacaccagaaagtggggtttctaattgcattaacaagcaatccgattgtgcaatttgcgcctcactttgacgaacgaccatctcacccaaatgtgcatttgcaccgctagccaacacaatactgttctcactagacttggcgacttgaataaatgccattcctgtcatttcctgtgaaacggtattaatatgggttgtatcaattccttcttgctcaaacgcatttttcattgttttgcctatgctatctgatccaatgcaactaatgaacgctacctttgcacctaaacgagcggctgccactgcttgattggcacctttgccaccataggcaatttgataattttgacctgttagcgtttcaccgggtttagcaaagtaaggcacagaaataacgtgatcagcattgatactaccgagaaccgtgagggtttttttcattattttatcctgtattgttatattttttctttctacacaatgggacaaatataatttgccccataatgtgatataacgagcttatttagtagatagattattcacttattactttcaaatctactggaattttcgcttcaactttttcgccctttaagattttatcagcggtaacaacacctaatgaaccaataagctcgggttgttgtgcgatagttgctgccattttgccactttttaccgctttaacaccatcatcggtaccatcaaaacctacgataaggacttttttatttgcggctttcaccgcacgtaatgcacctaatgccatttcatcattttgcgcaaaaattgcttgaacatcacctttagatgccaacaaattttccgttacattcaaaccttttgttcgatcaaaatctgctggctgactggcaagcacattgaatttatgagcatcaatagcttgtttgaaaccctcacctcgttcgcgtgccgcagatgttcctgcaataccttcaagttgaatcaccttggcattatcgcctaattctgtgcgataaatcacctgccttttaccactgcggggtctc

SEQ ID NO: 376 - DNA, 1855 bp, H. influenzae
cgttatactatatcgactcggtattctcacttctcctaaaacgttaaaagcacaaccttaatctgttgtgctttttgattgatgccatctacaagtactagtttacgatcttttatcatcaaatcgtgttgtccactcaattttaaatcgatcataatggtttccctgttgtaccaccgctatcgcctttgtgcttgtgactttgtaatgacacaccatctgccataacatcgccagttgtcgttaaagaaccactaacggatacactgccactgttacctgccgttgaaataccgccatttacgattacattgccgttaaaggtgctggttgtcgcagtcacagtaaaattatccgttgttacccttacatcaggcgaattgatcgtaatattgccatttggtgcgattttaattttaccgctaccgtatttaatacaaaggttctcaacatcggcatttggagagcgactattaccgcccattacacaaaaagcatcggataaatcaaacattcgcggatcatctggcgcatcattgcttccacttaaccaattttctagagatcgctgcgaaaaaatcagcaagcagccgtctcccgctttcactggtaatgtcacttgtgctaccgcaccgttaatgtctgccatagggaacattaccggcacgtttacaatctgcggtgcatttaatacttcgccattggctaaccgcttaggaatagagggttgtaccgttgctcgcaccgtttccgcatcataactaacaatttttccaggtaatgacacattaatttcagaaagtgcggttaaaatatccgtcatttttaatcgtcctttttcttacgttttttacgatgtttactttgcgtttccatctgcgttttagtcggtgcgtttagatctactaaatgtagttcgctttgccaatcgctagaatgactatcccccgaatgcttgattttttccacgcggaaccaatttgttaccgtcacactttccagcttgattttgtcacaagggtttaccataggcagtaacaggctttttacattccaaccgtccctcgcttgccgatcaaaggcaaatttctcatctttctttttatttggcgtatcctgcttcttactgcgtgctgcttcacgtgtgcgttcaggaaaaccgattagcccgctatcttttgccaacacataacccgatcgctttgtcacgccattgcggtttacaatctgcagttcgccattttggatcgaccactcaagccccgttcctgcaacgactttgtctaacgctttacgtgcggcaccgtaaaaactaaaaccatttgcccaagtgcgtgatttcaaattatctgcaccaactacggttacgcccatttttgcagcaatatcattagtaatttgcgtagaactcacgccaccgacataacctaatgaaaccgccgtatcgcgaatttctaccaagccatctaaaacataaagctccgttacccaatctgcgccttcgtgatacgaatatgccgtggcaatatcgccagagcataacaacacgtcacctttctgcgcataaccgggatacagcacgcaccgcatatccggctgctaatagtttttcgtgtagtggatgcaaggtatagattttaatgggatttttcgtccgctcggcttcacatctttttcatatccgactcatacgcatgggcgctcatcacatggcatcttttgcctttcttgccatcatcattataactcgtaaaagcgatactcatcatccactcgattaaacacaccgccttgcatgataaaattacgccaatcgtgggattatcataccacggataatttcaggggattctcc

SEQ ID NO: 377 - DNA, 3042 bp, H. influenzae
  misc_feature (2902)..(2902): n = a, c, g, or t
  misc_feature (2926)..(2926): n = a, c, g, or t
  misc_feature (3026)..(3026): n = a, c, g, or t
tggtttcgaattcggactcggtacccctaggtagctatttttacactcaaaaagggaaatttaaaatgaaaaattttacattgaatctattttgcgaagttaggaaaaaatcaggtgtttaagaaaagaataattgataccgctttttaacttgatatttgcttttagtgtgtagccgacaccaattgccatcgcattacagctgccataaccgcccaccgcagcagaaaaactcgcttttccaaccacttgtggcaattctaaaccagaaagggcgttagccgccgctaaaccacgttctaatttactgtctaacttaccaattttgccatttaactcgttaaagcctgattggaaattttactattaattgtattattctttaaattaccaatgatcaggctatacgccccaaactctttaatgccgtaattcgtactaattgaattgtcactcgccgcaaaggcttgagaagagatcagcaaactgtgctgataagtgaagctgtcatggttggcttgacagatgaaaagaaaagattagcattgcttgcttgcttgcttgcttgcttgcttgcttgcttgcttgcttgcttgcagaattgtaataaaacatgttatatcctcctaggataaaacaaaaaagaagcgtgactttacgttaaataaattgatatgtaaaggaaatacaaattttttcgtgcaaattccaatatttaactttaaaatacttgcctctgaacaaacattcattataaataaaagtcacaatatttattttataaataaaaaagtgcggttaaaatcatccgcactttttagttcgtagaaaggaaaattcaatgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgtgttatagagcaagctttaacaaacaataaagatttagctaaagctgctgtagcggtaaaccgtgcgctttatagtgcgaatttagtgggtgcaaatttagtgcctgcatttaatggttcaacttcatcagcagcacaacgccgagttgatatcagtacaaactctgccacttcacacaaaggttctttaaatgtgagctatacattagatctgtggcaacgtttggccaatactgttgatgcggcggaatggtcgcacaaagcaactgcagaagatatggaatcggctcgtttatcattaatcaattctgtagtaacaacttattatcaaattgcttatttaaatgatgctattagcacaaccaacgaaacgatcaaatattacacggatattggcaatattatgcaaacgcgtttagcgcaaggcgtggctgatgcagccagcgttgatcaagctcaacaagccatattaacggcgcgtaataacaaattaaattttgaaacccaacgcaaaacagcagaacaaacactgcgtaatcttctcaacctaaaaccaaatgaagcattaaatatcacgttcccacatattatgaatgtgaaaacggcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacagttggtacggcattacataaccctgtggctgctggcacagtaggaattagcttgccattcttaaattggaacaccgtaaaatggaacgttaaaatttctgaagctgactatgaaacagcacgtttaaattacgaacaacgtattaccacggctctcaataatgtggataccaactattttgcctttacccaagcgcaaagtacattaagtaatttacagcaaacccatagttacaatcagcgtatcacacaatattatcgaaatcgctataatgcgggcgtgtccgaattgcgcgaatggttagttgcagccaatacggaaaaatcatcacaacttgcgattttgaatgcaaaatatcaagtgctacaaagtgaaaatgcggtatatagctcaatggcgggatattatttgtaaaaatcaaattggattaatctataaaaaatccctgttaaatttctttaacagggattttgttatttaaattaaacctattattttgtcgcttctttcactgcatctactgcttgagttgctttttctgaaaccgcctctttcatttcagttgctttttctttcatttcgcctactttttctgatgcagcttctttcatctcacttgctttttctgatgcagcttctttcatttcacttgctttttctgatgcagcttctttcatctcacttgctttttctgatgcagcttctttcatctcacttgctttttctgatgcagcttctttcatctcacttgctttttctgaaactgcctcttttatttcagttgctttttctgatgctgtttctgttgctgatttaattacttctttcgcatcttccactttctctgctactttatttttcacgtctgtagaaagctgctgtgctttttcctttacttcagtcattgtattagctgcagcatcttttgtttctgatgcgactgatgctacagtttgtttcgtatcctcaactttttgttttgcttcttgcttatcaaaacaacctgtcacggctaaagctgaacctaaaaccaatgctaatgttaattttttcattattttctccatagaataatttgattattacaaagccctattactttgatgcagnttagtttacgggaattttcataanaagaaaaaccataatagtaaaactttacctttctttaaaagatactttataaacaacatctaagatactgatttttaatagatattataaaaaccctaanaattttattttttgac

SEQ ID NO: 378 - DNA, 2262 bp, H. influenzae
atatttatgtttccccaagtcaaatccgtcgttttaatcttcaaactggggataaaatcgaaggcaaaattcgtccaccaaaagaaggcgaacgttattttgcacttttaaaagttgatcaagttaatgacgacaaaccagaagtttctcgtagcaaaatcttatttgaaaacttaacaccattacatgctaactctcgtttaagaatggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaaacaaccgcacttctatgaagaacaagggaaaaatattatgttttcccctttttaatatccgtaatatttgacgagataaataatgatagccgataagttcataaaaggggcaaaaggtataaattcttttttctttttatgaataagcgaaaaacatattccaagcactgaggctaataataaaaagtgcggtaaggtttctaaatgaataaaacttcctaatgccattgctagccaataatctccccgtccaaaggcttcttttctataataacattttgcaatccaatagattgcgtagaaaacaataaaaaaactagccgcactttttatgctttcagataacgttagcaatgaaaagttattgtctgcgccaaataaaccgagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgaccgcactttttttgttgaatagaggcaaagtgcggttgaaatggagaactgttttgtggaaataattcaacgtaagtcgcataaatctcttgctgcaaatgcgtaataaaaccagataggtagaaccacaatgcgatccctaagatgccgcctaataaaaacattgtgaagtaaatcattgaataactgatcccatattaaagataggtaaatacattcccatcataataatcccaatcagactgccgatgattaccatcattaatggttctagcatttgtgagagtaagtcaatttgatgattaagtttttcttggtaattatctgcgatatgctctagcatcaaagcgagttttccgctttgttcgccaatttgtagcatttgttgtgcttccatcgggaaaagatcgctacttacgctattagaaaacgcatagccttgagaaacccattgcaaaattgaccgcacttctttatctaataccatatcgtttacaagcgttttcttggtttgccaagtttgtgtgcgaggaagaaaactgtctagtgcctgattaagcggtacgccggcctgcaacataatttgtaaactttgactaaagttcactaaacgtgaaagcttttgaattgtgccaaaaataggggtaccgagtcgatatcgtaaaca

SEQ ID NO: 379 - DNA, 2266 bp, H. influenzae
gagaccccgcacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataaaccagttatttgctctattttgttcaatcgataacgcaaagtattcgggtgaacaaataatttttccgcagtgagataaagatcacaatttgataaaaaatattgttgaagggttttataaagtgtcgcattttcttctgagaaaaggggagaaaggggttttatcaattcgttcccttgccaagaatgggataatccagcaagtaacacaggcaatcgatgctcatcaaacacataaatacccttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagatgctgtaaattatccagggctggattaagtaacttaatcaatacaaccacacgagatttatttaaatcaaaagaaaaaaatttcgcctgctgttccatctttttccaattcaaattgcaatgtaataattgcaaaataaattcttctttgtaacgacgatgccagctttcttgttcgagtaaagcctgttgttccacaataagttctgcggtcattttcactagttcggcatattgtttcacctgagttggctcaccagaaatccccaccactccaatatttttgcctaaataatgaatcggtaaattaatccctggttgcgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatccctagtggaaaaatgagatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccatttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcgtttttatattatttttggctacatacagcaataaaatgtaatttatgttcaggatcattaaaggttttgcacatcttttaaattgctcacgattttccgctttcatcgcattacggatgat

SEQ ID NO: 380 - DNA, 3610 bp, H. influenzae
  misc_feature (3567)..(3567): n = a, c, g, or t
gagacccctaacggtttgttcgtccgattgacgaacataaggcatcgccacgatcccacgatcataattgccagactgtaaatctattaataattcaggcgtaagctcggcattgggatcaaaataatccaataaataatcatctaaaatgccattaggcagtaaagcatcgtcttcaattgggaaccatttttcattgggataatgtacgaaatcgccgtttgcaatttcttgtcctaaatagaaatcggcaaagaaataattagtagaaagacgctcaaaatattcgccaagggcagaggctaacgccgcttttttacttgcccctttaccattagaaaaacactgcggacagtctttatcgcgaatatgcacagaccacacatttggcacaggattcaaccaagatgcctcttcaatattaaaaccaagtgcggtcaatttttgctgaaattttgcaatactatcttctaatgcagcatctttgccgagaataaaggtttgttctgtcatttttgttcctaaataagaaaaaagtgcggtgaataataggggagttttaatagcggggcaagattttttcggcaaaaataaatcccgaaaaacttcggggttttctaccgcacttttaacgtatatttgattggcgttaaagtaaagttggattgaaccgcacttttaaggcaattgtaattgcggcgaaaattttttcatcgttgagaggaaagttttcgcataaagtgcggtgggaatcagttatgtttatttgagcttgcgataattcatttaataaaatcgggagagaaagattaagttgctcggcgatttgttgaatagagaaatgttcgaaagtcatcatcaagcgatctaaattgcagtaagaaggcatgcgattatttgtgatgagatcggcaaattgagtgttgatttttacccatttcttcttacggctataaaaatgcagtaacaaaccaaatacggtaaatccagcaaagaaaagatgaatgtctaaggcttgactaaaaggaaatcctagccacattgaaatgccacttgcaacaacgaaaagcaaacttaaggctagtccccacactaagaaaaatttataaattacttcaaatttcattgaattatccttttctacgaaataaatctgtataaggaaatatataacgttaaatattatagaaacattttgcctgtttttgctacgttatatttgaattaatatatcgatgctgtagaatttgttgtaatgtctcgtttttaaaaaagttaaaatgaaaaaacgcttaccattttaaccgcacttcgtccaaacttttacatcaacatttgaataattacattgaaaaatcactatgactatttacgacatcaattttgctgaactgtatcaacaacacttaatcgcttgtcatcattacaacttacctccgacaaaatgggataaaaaagccgtgaaaatggcagaaaatttggtcggtaagccttcagcatataatcagcaattattgcaagcaatgaatgtgcaaaccgatgaaacagtgttggatattggctgtgggcctggtacttttgctgtaccgctcgcacaacaaggttcaacggtatatgccttagattatagtaatggaatgttagattgcttggcgcagttcaaacagaaattggggttgcataatctcacaacatttcataaatcttggacggataattgggatgatgtgccacaagctgatgtagtgttggcatctcattcaacgttggtggacgatttggacgatatgatcgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaatctacgaggatttattagcctcggtggaattttctttaggcgaactgtccgaaaaagaaaaacaaggtttgaaagccttttacgatcgtaaacaagccaataacgaactaatttttcatggacagaaaaaatgggcgttgatttggtggaatgtggatcgcatctaatgtttcaagtggaatcaatttatttttctatcactaattaaaaggacgattatgttatttgctttacctgcgctgaatgataactacatttggctttatcaacgagaaaatctgccgcttattattgtcgatttgcctgaaacggacaagctgtttgcatggctagataagcaaaacgcaacgattgaagcggtgttgcttactcacgaacatgaggatcatacacaaggtgtgtcggcatttaaaaaacgttatccaacagtgccgatttatgggccgcaagaatgtgagaaaaaaggtgcgactcaagttgtgaacgaagggaagatccttaccgcacattatcaaattgatgtcattccgacggggggacacactaaacagcacgttagttttttagtggataatcatttattttgcggtgatgcgttattttctgcaggttgcggacgtgtttttacaggcaattatgcgcagatgtttgatggtttgcagcgtttgaatacattgcctgacgagacgattgtttgcccagctcatgaatataccttggggaatttagcatttgcggaaactgtgctggtggaaaaaagtgcggtagaaaaacaacgtatttttgttgaaacacaacgggctgaaaataaaccaagtttgccgacaaccttaaaacttgagcgagaaattaatccgtttttacaagcaaaaacacttgaagaatttaccgcacttcgcaaagctaaagatattttctaatattgggtgaggacaaagtgcggtgattttttaaattagcagattatttctttctcgctaacatggtggcaaatttcattttaatgcgattgccgttttcatcggttttgtgtaattcgcccatattttcgttatattctaagaattcccaatctttgtaatattctttcaattcgttttcagcaaaagtgaatgagaatggaagtgggcaaggcacatcatctgtggacattgcggcaacgattaaattatatccgccaacattggtatgttcttgcatatttgtgatgattgacggcacacgttcacgatttaagaacataaacaccaccgttgaaacaataaaatcatagttttcttgaatgttggcggcgttaatgtcgtaaagtgcggtagaaatattaaggttttctttctctttggtttcatttaaaaaggcaatgctgttttcattgtgatcccaagaggttacatcatagcctaataaacttaaataaagtgaattacgcccttgtccgcaacctaaatctaatactttacaaggcgagataatttttgctgcatccaccacatcgccgtgaatggcagtcatgttgtatttttactgaaatatcttcttttttgcaatagaaacctagggtacttntagggcggggtctcctagagtcgaccgcaggcagcaagctggc

SEQ ID NO: 381 - DNA, 2265 bp, H. influenzae
gactgcctatgcatgcctcgcaggttcgcactcttatagaatccccttccaaataatttacctgccaaatctttacaaaaatgaatttttgagctaataagtagaagactttttataaaaatatcgcctaataacaaggaggttcaaatgcaacacaaactactcttctctgcaatcgctcttgctctttcctattctgtgcaagcagttatagtgcctgaaggaacacaattagatgaaaaacaacatatcgtcatcaataacggggctgaaccgcaaagttttgacccacacaaaaccgaaggtgtgccagaatctaacgttgcttatcaattacttgaaggcttagtcacctcagactctgaaggtaaacttcaaccgggtgcggctgaaagctgggaaaatacacctgacttcaaaacctggacattccatttacgtaaagatgctaaatggtcaaacggagatcctgttactgcacacgatttcgtgtttgcgtggcgtcgtttagtggatcctgcaactgctgcaccttatgcgagttacttaagttatttacaagttgaaaatgcgcaagacattattgacggtaagaaaaaaccggctgaattaggcgtggaagcaaaagatgattacacctttgtggttcatgcaaccaatcctgtgccttatgcagtcagtttaacgactcaccaatccttattgccattaccacaaaaagtagtcgaaaaattgggtgatgcatgggtgaaaaaagaaaactacgtgggtaacggtgcgtataagctggctaaccacatcattaacgaaaaaatcgaatttgaacgtaacccactttattggaacgataaagaaaccgtaatcaatagtgcgacattcctcgccattgaaaacccaagtaccgatgtagcacgttatcgtgcgggcgatttagacatgaccagttatggtttaccgccagaacaattcgctaaattaaaaaaagaattgctaggcgaagtatacgttactcgtaccctaggaacttattcttatgaattaaacaataagaaagcaccttttgataacgtgaatattcgtaaagccttgaacttatcccttgatcgtaatgtgatcaccgataaagtattgggccaaggtcaaacaccaacctatgtgtttaccccaacttacatcgaagaaggtcatctcattcaacaacctgcttattcaaaagaaccgatggcacaacgtaatgaagaagccattaaactcttagaagaagctggttacagtaaagcgaatccgttgaaattcagcattctttataataccaatgaaaaccacaaaaaagtggctattgctgcagcttctatgtggaaagctaacaccaaaggtttgattgatgtgaaattagaaaaccaagagtggaaaacttacattgatagccgtcgtgcaggtcgttacgatgtggcgcgtgctggatggcatgcggattacaaccaagcaacaacattcggcaactatttcttatctaattctagtaacaataccgcgaaatatgcgaatccagaatatgataaagcgatggcagaatcttacgcagcaactgatgcagaaggtcgtgcaaaagcttatgcgaaagccgaagaaattcttggaaaagattacggtatcgtaccaatctttaactatgtgaatccacgcttagtgaaaccttacgtaaaaggttattcaggcaaagatccacaagatcatatttacttacgcaatctttatattattaaacattaattcgttgctcgtatttaagtgcggttaaaaatcgtcgtattttttgaccgcacttttcgcccattttggttggagttgttatgctcaagtttatttttaaacggctgttggaagccttaccgacgctgtttattttgattactttttctttctttttgatgcgtcttgcccctggcagccccttcacttctgaacgcgcttatccgccagaagtcatggctaatatcgaagcgaagttcttttaaaatgacccttttttaagccatatttctctttattcaaaaatctttccataggatatcccgggccccccttattaaaaaattgaccaaccctgcataggatccatatgcgtgcagccttccccgcttttctaataatcggaactggtggcctttccctttcgacttcggctagacgcactccccgtgaccctgcgtcctttcacctaaaaacccaggttttatttttcagccatcctttttccgctga

SEQ ID NO: 382 - DNA, 3924 bp, H. influenzae
ctggtatacgaatatcagcctcggtaccccgctttttcggctgctttatcaaactctacatcgcctactaattttccatctactcggttaattccaacatcaattacgaccgcactttctttgatccaatcgccagaaattaaatttggtttacctaccgcaacgacaagtatatctgcttggcgaacgtgattttccaaatttttagtgaatctatgtgttactgtgacggttgcccctgctaataataattctaaagacattgggcggccaacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaaaaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttgtctgtttaactagatcctgtttagttctttcaaatataagcactttcagtctgttagatttcatgctcataatctgcatcatttgagtgaagaagcttaaatacactcttaatgatgcagataaaaacaatattttggctatttaagtattttccaagctctgaagccataaatggcaattactacaaaacagattaatggtaggataaaggagaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaagacataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccctcagctttagtgaagcctaaacgttcagcatattgtacgataaatgtccaacacataatttgaacacccacgtaaaaggcttgtgcgatcacaccctcacgatatttagcttttttagccagtttgcttattgcacttttaaagctaatttgtccactttcttctacttttacagcaggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaattcgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaagacaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagactggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtacttcagaaatgtccacaacatcaatcggtaaatttaaggtgtttgcacggatttgat

SEQ ID NO: 383 - DNA, 2911 bp, H. influenzae
  misc_feature (2836)..(2836): n = a, c, g, or t
  misc_feature (2868)..(2868): n = a, c, g, or t
  misc_feature (2875)..(2875): n = a, c, g, or t
  misc_feature (2881)..(2881): n = a, c, g, or t
gaccaccatttgccccatatcaccgtcggtactgatcccgtcatcaatgaaccggactgccacgccctgagcgtcaaattcctttatcagttggatcatatcggcagtgtcgcggccaagacggtcgagcttcttaaccagaatgacatcaccttcctccaccttcatcctcagcaaatccagcccttcccggtctgttgaactgccggatgccttatcggtaaatatacggtttgctttcacacctgcgtctttgagtgctctgacctgaagatcaagagactgctgactggttgagacccgagcgtaaccaaaaagtcgcataaaaatgtaccttaaatcgaatatcggacaactcatgtctattattacaaatttacgatttaatagacatattaatgtaacagttttacgatgtccgataatttataacatttcgtacggttggaaaaatgttactaaatgcccgtcaggcagggaggccgatatgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggccctgcatgctgaaaacctgagtacactcccggctgtgcgcctgaaaaatctcgcacgttatgctggtatgacttcggggggtcaatattgccaggatgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaattgcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagtttttgacgacgcaccaacggaaattatcagtcggtcatggaaacggctggtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctcncacgcctggctgatgccggtgcttcggttttnctggcgnaatggnaccagggtaccgagtccgaatcgtatacag

SEQ ID NO: 384 - DNA, 2600 bp, H. influenzae
  misc_feature (2550)..(2550): n = a, c, g, or t
  misc_feature (2584)..(2584): n = a, c, g, or t
acgtaaccacggattattacacagtggtgcacgttacgccgtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaataaagtacgttgtatcaacactcgtttgctagaaatgaagaaatcactgagataattttgactagcttcagaaggttcttcacaaagggctaatttccaaattgaaaaattatgaacctggttttgaattgtttttatcgggtngaaggttaaacataaaatcgttcatttggacgtntttctttgccaaccac

SEQ ID NO: 385 - DNA, 3908 bp, H. influenzae
  misc_feature (3267)..(3267): n = a, c, g, or t
  misc_feature (3289)..(3289): n = a, c, g, or t
  misc_feature (3300)..(3300): n = a, c, g, or t
  misc_feature (3351)..(3352): n = a, c, g, or t
  misc_feature (3366)..(3366): n = a, c, g, or t
  misc_feature (3403)..(3403): n = a, c, g, or t
  misc_feature (3439)..(3439): n = a, c, g, or t
  misc_feature (3499)..(3499): n = a, c, g, or t
ataatttagtcccgtaaaattaagaaaaataatataagtgattaaagtgacaatcagtatttctaataattttccgtgaatgtaattagaaatttgctgttgcatttctttccatactttaaatgcgagatttctattttttggtaagaatcgacttaccccttgtaaaagttctgatttatctttcaacataaaaaacatcattaatggcactaaaaaggcataaatccctaaagaaaccaagttcataatagaggctaaagaaagttttacagcagattcgccaaaaccaaggattttttctcgcacagaattgaaaatagaatcaaccattgaataatcaataagttcaggataatttttgggtaaattgagtagccattcattagatttattaaacatagcgggcaaatcacttaataaggaaatagtttgattccacaacattggcaccaataccaaaaagaaaactgctgctagaccaataaaactaccgaaaataagaattgtcgctaacattcttgggcattttaaatattgatttaaaaaattgattggcatttcaagtaaataggatagtactagagcaatcaacaaaggcgcaattaaatctccaaaaaaataaatggagataaagccaaataataatattgctaatagtcccatcgcttgaggatcacttaaacggcgagagtaccagctttttaacatttctagcataatttcttttcctataagtatttttttgccattataagttaaaatttacagtgtttatagctactaagaggaaatcctatgtctgttattatttatcacaacccacattgctcaaaaagccgtgaaacgctagcattattagaaaataaaggtattcagccgattattgaactgtatttgcaaaagcagtattccgttaatgaattacaaagcattgccaaaaaattaggaattgatgatgttcgccaaatgatgcgcacgaaagatgaactatataaaagcttaaatttagataatttagatctttctcaagcagaattatttaaagcgatgagtgaacattcagcacttattgaacgcccaattgttattaatggcgataaagctaaaatcgggcgtccgccagaaactgtacttgagattttgtaatttaaacgtttgcatgtatagtacaccagccgtggaaatccttccgcggcttttttaaggaaaatttatgagaaagaaacaaaaaagtgcggttgaaaatgaaaccgtttatttgcacactcgaggcgtgataaaagataatgcagtgatggcattgctaggcgataaattatttcgtcagcgtgttgagaaaaaacgtaaagggaaaggcagttaccaacgtaaggcgaaacacccagggaaaatatttgaaaagcccgattataaatttttttgattacagaaactttataatcgggtttttcttaggttaaaaatagcaaggagttaaaatatgtcaaaacagcctcaaattctacttaattaatacgtggaatgtgcgtattagtgatcccggagaggagggggccaaaagccatttctttgaaacgatttatttaactctaacagcttattttgaagaaaataacatacgctatgaatttgtgcgtaaagtggaggatcaaataaaaattcagcgttcttttacagagttaaatgaattgttcaaatttttaggggattattttgatcccgtctcgattggtctagtcggtgtgaaaattggaaacttagggataaaattagaataaaatattgattaatctataaaatttcacactatattttacgattattgtaaaacaaagatcgcactttaatgatataaattacataaaaaagtgcggttattttttctttattttgataagaaaaatagattacttagcaacaaatttcttgtacgacaaattgtaatgaatgtctcgaaaattgttgttgtttgcggtgttttaaacgtcttaaacgtagattacgtgataaagaactttgttgtaaattagctttctttttaagaaaagttttacgttttaacattttattaatccttattttcttttatttcttctaaatttttaaccgcactttcgttgttggcattatcattcgttgtttgattttcttggactcgatgataatttacgatgctattcatatagcggcgaatattttctacatattgataggcttcatagcctcttgcatagccgtatttcagttgggaataatagcgtttttctgctaataaaggcagattttttttcacattgagccaattatctggatttcctccaagattttgagttaaacggcgtgcatcaattaagtgaccgagtcctatgttataggcaactaaggcaaaccaaattctttcttccttttcaatgctttcaggaagctgactaatcaaccagtgtaaatattctgaaccagctttaatactttgttcaggatctgttctatcactgattttcatatgttgtgcggtatttttggtgagcatcattatgccacgtactccagttggcgatgttgcgtcaggattccaatgagattcttgataagccactgctgcgagtagtcgccaatctaattcacctttgtatttttcaaagagcggtgagaattgtggcagggtattttcaattgcgttcatataagagcgcgtatccacgtaatcaaattgtgaaatatgtcctaaatatttttcttttaaattatctaaaagtcccgtttcttcggcattattcataaaattgagtaaagccgtttgtagatcgcggtaggggctattgggtaaataccagtgaacgtttgcttcatcagtaatatcaaaggcaatggctaattctggtttgatttgttgaattgcagcaatatcaatagaatttgcaataacgtaaggaattttgccttcagccagttgtagtaatagttcttcttgagtaagtgcttgatttcttttccaagttaattgtggatattgtttttgtaattcttttagcgtttcttctaatgctaaattatttgagatataaatatctttctttacgttacctaaatttttaggacgattttcattttttcgataagctaattgccatgaagcagaatgatatgcaggacctatttggaaacgttctgcatttttaggatggtataaaaggggggcggcagctaaatcaatattgtgtttatcaagttcatcaaataactgctcttgattatcgaaaattntcatttcgagttctacgcctanagtatcagcanatgctgtggctaattcatattcaaagcctcgttcgctatctttattaatannataagaaatctggntatttattgttcctacataaagtgatcccctagcttngattgcagtataatggatttcttcagtatgacgtanaaattgcatgggaacacatatcattagccccaaatatacgctagagcagaatatacgtanaaaagaccttcaatgatttttctatataaaaagtaatgggatgtgcccaaactttacttatggcataaaagcccctggaggtcaggggctaggggttgaaaaaatcgacgattattttaaaaggaaactaacaatcgggggggttgtggcataaaggggggtactttttattaaattcacaagggccgatattattgcctgtcaccgcccccctctccgggaaacccccccaactttaagttaccgggaaaaccccgtccccgggatttcggtttttcccccctaaaaaaattccccttttatatctacccggggttaaaaagggggaaaatttttgggactcttgggggacaagggggggggctcctaaagtataatacccatacggggtataacccctctttacaac

SEQ ID NO: 386 - DNA, 4200 bp, H. influenzae
  misc_feature (4162)..(4162): n = a, c, g, or t
  misc_feature (4192)..(4192): n = a, c, g, or t
gaagatattattgatacgggttatacgttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccattatattgataatcttgctggggcaattttcttatttttcggcggctatttagtttattcaggcgtgctagccactgcagccgcattttaattaccaaaaagtataaaatataacgaaagaaaacttgttatttttactgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgccaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaactggaaatcaataaaaaaatctgcaattgagaattcagttgcagattttttatcgctcaatacttttgactaaaaagtgcggtggttcttttcagtgttttataacttaaatcgatgaataatttgatttgcggaacctcgccaaactaaacttgggtcagcctgttcttgaataaatttcccatcaattaatacatcaatataaggcaacatagcacgttgttgttcgtctaattcatctagcttataacccgtccaaacccagatgtctttatcggggcattctcgttttacacgttgcacaaagggcaataatgtttctatgttacggggatgaagtggatcgccacctgaaagcgtgagaccttggcgtttaatgcgtgtgtcttttaaatcattgatgatttgttgttccattgcgtcatcaaataatacacccgctgaaaatgaccaacttttttggttgtagcaacctttgcaagcgtgcgtacagccactgacgaaaagtgtgcatcttgtgccttcgccattaatcacatcggtcgggtagtattggaggtagttcatttcataaaaatcctaaaaaggtggcttaaattctcgccaaattcaccgcactttttaattaatctttgcaatatgacggtaatttttgcataatagtgcgaaatcgcattgcgatatcaatggaaaccttctcggtctctcgcaacggtgtctggtttactcggtcaggtctggaaggaagcagccaaagtcggaattactgtgtgccgagaagaagctgggaaggtttccgcccaacttccttttctcatactcgctcaatcaatcttttaaagaaaccattttctttagtgattaaactattgtaatcgccttcttcgattaatcttccgctatcaattacacaaattttatcgaattgttcaattgaactgagacggtgagtgaccataattagggttttattttcggcatgttgcagaattaaacgtaaaatttgacgttcagtttcgcgatctaagccttcagtcggttcatccaataataaaattgacgcattattgagtaaaatacgcgctaaacctaaacggcgttgttccccaccagaaagtggacgaccgccatccccaagccaaagatttaaaccttttccctcttgctcaagtaatttacttaagccaacttgatgtagtacttcaatcatttgttcatcagaaattttatccgcacttgcaaattgtaaattttgacgaagtgtatcgctgaatacgtgaacacgttgagttaaaaaacaaatttggcggcgtaatgtctcttctgaataggcggaaatgggtttttctgccaataaaagttcaccttgattcgcatcataattgcgtactaaaagttgaagaagtgaagattttccacttccagttttgcctaaaatagcaatttttttgccctgttctaaatctaatgtaagattttttaatacgagtgtttcttgttcgggataggaaaaatttaaattcttcgcagaaattaaccgcactttgtttcaaattcctcgttgccattaaactcaacaatcggtttttgctcaatgatttcggtcacacgttctgctgccgcaataacttgacctatatgtaaaaatgctgcccccaatggcatgataatctcaaaggcggcaagtgcagcaaaagtgaaaagtgcaatataagccgtgcgatattcatctgtgccaaaatcggcgttacttgcaaaccatagcattccagaaatcaacaaaccattaagaaagagaacaagtgcggtagagaatccgcttaattttgcttctttggcttgatcttcctgccatgttttttctgtggctgacattttttcttttaatctatcttccgcattaaataataaaagctcggcttgtgcttggataaattctaaaaactgggttcgataggtcgcgcgtgcttggattaagcgttcgccaaattgctgtcctagtcgatagaaaacagttgggataatcattaataaaattaataaaaataagcctaaaccaagtgcgagtggaatattgataaagctaagtccaatggttatggcaatgattacaaatacagcagtgaaaaatggcgcaagtaaacgtaaatagaggctatcaagggtatccacatcggaaactaaacgatttaataaatcgctgttgcgataacgatttaataccgctgggcttaaaggaatgatttttcaaatacttgcacgcgtaatttggacaaaatgcggaatgttgcatnatgcgttactatgggaaccgagtcgatatncgaaaaca

SEQ ID NO: 387 - DNA, 2869 bp, H. influenzae
tgagttccctcacttccgtaaagggactgaaatcatttctcacgccattgcaaacagcgatgcattctctattgctggcggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaaccgcacttttcctctataacatattgatggtggcatcaaaaatgccatcatcaatacaaattcttcaaattgtgggcttatcccgctaaacataaaaaggaaacacaagtatggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgttttataatccacaaaaataacataaaatacggccgcactttcaagtgcggtttttttattttagcggagaaattatggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatttaagaagaattgaacaacgctgcctatgctggtggcgaaaaggacagtacccaagccaacgacaccaccaagtaaaaaaccaagtaaacaaaccgagatttcaaggcttgagcgtaccacgttgatgcttaaatgaaaacgttggcaaataccaaccattaatccgtctcgagggcctgcacctaagtgacaagtgagatataacgcagttccaaaaccatagagtaatataccgatcagacagaagatcattcgtgaaaaaagtgcggttggcggcgtcagtattttgttgtgatccctagaaatagagcaataacgataatatttaataatgtcccaagcccaagg

SEQ ID NO: 388 - DNA, 3761 bp, H. influenzae
cctcgtaagccctttggcttctgtcctttgcaattgaatattgttaatggtgagtcataattggcttttatatctgaataaatgggccatttctcctctggtacttgaagatttctactgatgtttctgcagaaagatcaataaactgacctttaccctgctctggctgaacaaaagacttttgattagcttcataatacgttttgatttcatcatcagagactgattgttttgccatttcatcttcaagagataaagttgctaaacgagctaaacgcttttgaaagaaaacttctggccctattttttacttgagcaggaacaataaattcactgttagcaacgccattttgtatttgttcaagaggtaacgaagcacgtaaaattgaagcgtaaccatctgaagttaaatgattttgttgtaatattcgttgataaacagcattatcaaatttaccctttacttgaaaattaggatcggtcacgattgcacgtttaatcatttcatcactcacgcctaattttaattctttaacatattggcgaagtaattcttgatcaatcattagattgacgatgttttgacgaagtgcggtaacaaattcaggagaatctgactgagccacaaacgcctctccctcacgttgtgcgcgtatttcaaattcttgattatagcgatttaaaaaatcttgttgagaaatcacttcgccgttcacttttgccgcataagtatcatttgagctaaaaagatagccagacattccaccaactaaaaacgatacagtaatcaaacctaagataaatttagaaacctttgagtttgttaaattgtgcattttttcaattaacattctataacccttgttataaatataaaattttcctgattataatctaaacgtaaaaaattagcatcttaaaaagtgaaaactccatgctcacaaagccagctaataccaattcctatcaacaaaacaccaccaaatattgccacttttgatttaaatttttgccaaaaaatgaccgcactttacgcttcctattttccaatgcagaaagaactaaaaatattaccaagtaaatcatcggatgtgaattgacccgtaatttcacttaaatagctttgaactaagcgtaattcttccgctaaaagttctcctgcatgaaattctgtaagttgaaccaaaccgatttgtaaatgctctgcggctttctcaagtgcatctaaatgacgacgacgagctaaaaatcccccttcgatacctgtttgaaaacccattgcttgtttcaaatggtcacgtaaaagttttacaccatcatgcgtttgagcagaaagactaataatttgataaccgccctgttcgctttcacttgcttgttcgccatttaaatcaattttgtttctaacaatagtaactggcaaggttgagggtaattttgctaaaaattctgaccgcactttgcttaaatctgcactttcaggatcgctactatctaacatcaaaataatacgatcggcttgttcaatctctgtccaagcacgagaaatcccaattcgctctacttcatcggttgcatctcgaagacctgcggtatcaataatatgcaatggcataccatcaatatgaatatgctcacgcaatacatcacgggttgtacctgcaatatccgtgacgatagctgcttcgcgaccagcaagtgcattaagcaaactcgatttgcctgcattcgggcgaccagcaatcacgactttcatcccctcacgtaaaatagaaccttgtttagcttcagaacgaacattttctagctgattaataataccgcgtaaatttgcttcaatttttccatctgccaagaaatcaatttcttcatcaggaaaatcaatgcttgcttctacataagtacgtaaataaatcacagaatcaaccaattcatttacttttttagaaaactcgccttgtaatgattttaatgctgagcgtgccgcttgttctgatgttgcatcaattaaatctgcaatggcctctgcttgagcaagatccaatttatcattcaaaaaagcttgttcagaaaactcgcctggtctcgccaaacggattccgtcaatttgtaaaatacgtttgagtaataaatctaatacaacctgcccaccgtgaccttgcaattccaacacatcttcaccagtaaatgaatttggcgatttgaaataaagcgcaatcccttgatctaaaatagtgccatcagcatctttaaaaggaagataatctgccattcttggcttagggcatttacctaatatagcttgagcaacttttgttgctaaaggccctgagacccttaaaatcccaatgccaccacgacctggtgcagtagcttgagcaacgattgtttctttcataaaaaacctattattgtctggggaaatatgatattacctagggtaagtataccctaggtttatcccagtgctacccctttggggtagagcttgatgttccccaaaggggaactactattactataattaaccgtgggtatacttacccacggttgattgcctagggtaagtatactactacctagggtaagtataccctaggtttatcctagtgctacccctttggggtagagcttgacgttccccaaaggggaactattattactataattaaccgtgggtatacttacccatggttgattgcttagggtaggtacacactacctagggtaggtatactactacctagggtaagtataccctaggtttatcccagtgctacccctttggggtagagcttgacgttccccagaggggaactattattactataattaaccgtgggtatacctacccacagttgattgcttagggtaggtacacactacctagggtaggtatactactacctagggtaagtatacccctaggttatcccagtgctacccctttggggtagagctttgatggtccccaaaggggaactattattactataattaccgggggtatacctacccaccggtgattgcttagtggtaggtacactactacctagtggtaagtataccctagtgtttatcctagtgctaccctttggggtagagcttgacgttccccaaaggggaactattattactataattaaccgtgggtatacttacccacggttgattgcttagggtaggtacactactacctatggtaggtatacccacggcagtaaaataaagaaaaggcacattccgtgcctttctttttgcctgttcgtgactatttttacgagaatgcaacccttttttctctaaaccacgataaattaattgctgttgggcgatagtgatcaagttagatactaaccagtataataccaagcctgatgggaaccacaagaaaaagaacattaaaactaatggcataaaattcattactttttgttgtgttgggtcagttactggtgttggagacattttttgcaacaagaacattgagatacccattaaaatagggagaatgtaataaggatcttgtgccgataagtcttggatccaaccaaagaatggtgcatgacgtaattcaacggcttctaagaacgtccagtataatgcgatgaaaattggcatttgaagaagaattggcaaacaaccaccaagtggatttactttttcctctttataaagcttcatcatttcttggctcatacgttggcgatcatctccaaaacgttcacgcatttcttgcattttcggttgcaaaatacgca

SEQ ID NO: 389 - DNA, 3484 bp, H. influenzae
  misc_feature (3112)..(3112): n = a, c, g, or t
  misc_feature (3126)..(3126): n = a, c, g, or t
  misc_feature (3153)..(3153): n = a, c, g, or t
  misc_feature (3231)..(3231): n = a, c, g, or t
  misc_feature (3244)..(3320): n = a, c, g, or t
  misc_feature (3323)..(3354): n = a, c, g, or t
  misc_feature (3357)..(3364): n = a, c, g, or t
  misc_feature (3369)..(3370): n = a, c, g, or t
  misc_feature (3372)..(3396): n = a, c, g, or t
  misc_feature (3403)..(3407): n = a, c, g, or t
  misc_feature (3409)..(3414): n = a, c, g, or t
  misc_feature (3416)..(3416): n = a, c, g, or t
  misc_feature (3419)..(3439): n = a, c, g, or t
  misc_feature (3441)..(3442): n = a, c, g, or t
  misc_feature (3444)..(3445): n = a, c, g, or t
  misc_feature (3447)..(3453): n = a, c, g, or t
  misc_feature (3455)..(3461): n = a, c, g, or t
  misc_feature (3463)..(3465): n = a, c, g, or t
  misc_feature (3468)..(3468): n = a, c, g, or t
  misc_feature (3470)..(3475): n = a, c, g, or t
  misc_feature (3477)..(3477): n = a, c, g, or t
  misc_feature (3479)..(3479): n = a, c, g, or t
  misc_feature (3481)..(3481): n = a, c, g, or t
aatgttgttgaaatcgattacaaagatatcgctacataaagaactatattcagaaagcggcaaaattgtacctagccgtattaccggtactcgtgcgaagtaccaacgtcaattagctcgtgcaatcaaacgcgctcgctatttagcgttacttccatacactgacaatcatcagtaattaaggagacacggtaatgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataatttatccaatagataaaataaaacccagtttaaaactgggtttttttatttttatcatatataaatttagaatagggtaataaaaaatatcccttattttagtagatttgagccctaagtcatatagagctcaaattttctgttgggatagattttttactcgtataagcgaattacatcattccacccataccgcccattccagcagcacctaaatcggctttatcatcttttggaagatcagttaccatacattcagtggtaatcattaagcctgctacagaagctgcgaattgcaatgcagaacgagtgactttagttggatctaagatacccatttcgatcatatcgccgtattgttctgtacctgcgttataaccaaagtttccttctccatttttaaccgcacttgccacaacagatgcttcttcgcctgagttagtgacgatttgacgtaaaggtgcttccatcgcacgtaatgcaagtttgatacccacattttgttcttcgttgtcaccttttaggcttgctgcaactttcgctgctgcgcgaactaatgcaacgccaccaccggcaacgataccttcttcaaccgcagcacgagttgcatgtaatgcgtcatctacacggtcttttttctctttcatttcaacttcagttgctgcgcccactttgattacagccacgccgccagctaatttagcaacgcgttcttggagtttttctttgtcgtagtcagaagttgattcttcgatttgctgacgaatttgagccacacgacctttgatttgtgcttcatcgccgataccatcaataatggttgtgttatctttattgataacaacgcgttttgcttgacctaaatcttccaatgttgctttttcaagctccataccaatttcttcagaaatcacagtacccgctgttaaaattgcaatatcttgtaacatcgctttacgacgatcaccaaaacctggtgctttcactgctgcaactttcacgataccgcgcatagtgtttactactaaggttgcaagtgcttcgccttccacatcttcagcgatgattaataacggtttacctgctttcgctacaccttctaacacaggaagtaattcacgaatgttagagatttttttatctacaagaagaagatatggattatctaattcaaccgttgcagtttctggtttgttgatgaaatatggagaaaggtaaccacggtcgaattgcatgccttcaaccacatctaattcatcttcaagacccgtaccatcttcaacagtaattaccccttccttgcccactttttccatcgcttgtgagattaattgacccacaatgctgtcagagtttgcagaaatggtacctacttgttcaatttcttttgctgtttcacaaggtttagataaatttttaagttcagaaacaaccgcacttactgctttatcaataccacgttttaaatccattggattcatacctgcagctactgctttcaagccttcatttacgatagcttgcgcaagtacagttgcagtagttgtaccgtcacctgcagcatcatttgctttagatgccacttctttcaccatttgtgcccccatgttttcgaatttatcttctaattcgatttcacgagcaacagacacaccatctttagtgatagttggtgcgccaaatgatttatctaaaattacattacgacctttcgggccaagggttacttttactgcatccgctaatacattcacgcctttaagcatttttacgcgtgcatcgttaccaaattttacgtcttttgctgccattttctttttccttaatttaaaatattccacaatcgccaaaatttcgcatttatcaatgattaacacttcttcaccatcaattttttctgctttcacgccgtaaccgtcgttgaaaatacggtctcgccaactttaacatctaaaggttgaacggtgccattttctaaaatacgacctttacccacagctaatactttcgcgcgggttgatttagtcgctgctgaaccggttaatacgataccgccagctgaacgggtttcctcttcttcacgtttaataattacacgatcgtgtaaaggacgaatattcatgattaatttccttcttaagaatttgtaagtgcggtttctatataaggaggattttttttctttcaaggctcttacaaaaaattctgacaaaatatttttcctattttagattttttacgtaaaattcgctgactttcgtataataaattaaggaatgaaaatatgcacttaacttccagagaacaagataaactgatgcttttcctcgcgggcgaacttgcggcaaaacgcatagcacgcggcgttaaattaaattatccagataccattgcttatattgcgagccatttacaagaggctgcaagagacggaatgagtgtagcggaagtgatgcaatatggcgcancacttttaactgtngatgatgtcatggaaggtgtggcaganatggttcatgaagtccagattgaagctactttccccgatggcacgaaacttgttaccgtgcataatccaatcaaaccncggaaaggggggnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnnnnnnnnnnnnnatnnnnnnnnccttnncnnnnnnnnnnnnnnnnnnnnnnnnnccatttnnnnngnnnnnngnctnnnnnnnnnnnnnnnnnnnnngnngnngnnnnnnngnnnnnnngnnnctngnnnnnngngngnggg

SEQ ID NO: 390 - DNA, 2069 bp, H. influenzae
  misc_feature (1805)..(1805): n = a, c, g, or t
  misc_feature (1838)..(1838): n = a, c, g, or t
  misc_feature (2059)..(2059): n = a, c, g, or t
ctgtgaaccacggttcggccgcacatataaaaatcggatatggaaggatgatcccatcataaacaattatgcattttaccggcaaagcccccacaataaggacaatgtggtttttcactggttaaacataagttttcattatccacgacaggttgaaaacttgatgcagaccaacttaatcctcgacaattattgacacattgaagacgctccaaagtaccatgtacttcataaacatggctatcattaaaaccagccttttgaaaatgcccatcaacattactggtaaaaacaaaatatccatgaggtttatctcccgcccagcattttaaaatctgatacccttcgtgaggaagagtatttcggtattgaactaatcgatgcccataaaaccaataggctagttcctgattatgcttataagctagtggcgttgcgatctcttcaaaagatatattatgttctttaaacataggataagcattccaaaatccgccaacgctgcggaaatcgggaagcccagaatccacgctcatacccgcaccagctgtaattaaaatgccatccgctttgcggataagttccactgcataattcaaatcatttttcataatacttttctctgcccatttttcattgatgaaataatacccgcttgttccaactgttctaaaatttgcccagctcgattaaaacccaacataaatctgcgttgaatcattgagcaagatgcaaatttttgttgttgcacatatttttttacatcctcaaaaagtggatctcttgccataattactttcattgccattatttgctcctttttcttaattaaaggctttataaatatgtaagaagtaaagaatttctctttatggagaaattatatgaaaggaagcgacaacttgtgtcgtttgtgaatattgaaagcggttatttttagaagattttttgcaaataagatgctctgtattgcaatatgcatatttatctggttatatatacatgttagttattaaggaaaataatatgaataaccaaaacccgattgaaatttaccaaactcaagatggcacaacgcaagtggaagtgagatttgaaaatgacaccgtttggctttcccaagcgcagatggctatgttatttggtaaagatattcgcaccatcaatgagcacattaccaatatatttgatgacgaagaacttgagaaagaatcaactatccggaaattccggatagttcgccaagaaggtaaacgccaagtcaatcgtgaaattgagcattatgatttagatatgattatctctgttggctatagagtaaaatctaaacaaggcattagtttccgccgttgggcaactgcacgtttaaaagaatatctgactcaaggctataccattaaccaaaaacgtttacagcaaaatgctcacgaattagaacaagcacttgcgcttattcaaaaaacggcaaattcatcggaattaacgctagaaagcggtcgcggattagtggatattgtcagccgttatacgcatacgtttttatggctacaacaatatgatgaaggtttacttgccgaaccacaaacacagcaagggcggtacattaccgacttatgctgaggctttttctgcactagcagagttaaaatcacagctgatgacaaaaggtgaagcaagtgatctctttggacgtgaacgagataacggcttatctgcgattctaggtaatttagatcaaagtgaatttggtgaacctgcttatccaagcattgaagcaaagcggcgcatttactttattttgtcgncaagatcatcctttttcagatggaataaacgtnagcgggcatttttatttgggagattcttactagaaatgggcggttggtttgacattatgggtacccagttttcatggtactgggcttgccgggctcactttatagttgctgaatctgatccgaacaaaagaacgcttttaggcttatatgcctatgcttagcagaaaaaaatgataatgcgaccgatccgcttttggtaaaaagggggcattctctatggntttgggggcc

SEQ ID NO: 391 - DNA, 2409 bp, H. influenzae
  misc_feature (2375)..(2375): n = a, c, g, or t
tgacggggaaaccagtgtatcgccttatgcatataattattcacaaggccaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaataattgaaaaagggcagaattaaatctgccctttcgcttacaaaatatacgcttcttgaatatgatgtggcttttggtcttcttctggtggaagcttcatataatctccataatattgcgttaagtgttcgtgatatccattcattacttgaaattgtcgtccttcaaattctttataaacaatgtgattaaaatattctttcggcatataagatttttgccaaccaccgtagtcagataatacaagaccaatataatcgcattgttttatcggatattttatttggaattgtgctaaatttttttgcattttggaaaataaaaagtggcttaatttaccaagtatcgttctttgcaaagtattttcttttgatcttaaccatcttttcttacaagaagaaaatcgaagtttaattcttcggtgctttttcatcagtgggtaaatgatctttggttcattcggtacaccatcgtagataaatatatccataaacatcgggctttttcttcccttagcatctgttatttgagtgcgacaatcgaaaatttttgccatttcaccggtatattgagcaagtatatcttctgccgtttccatattgtagtattcgtgagtttcttgaaaccaaacatcaacgaacctttgatattcatcacggtgcatataaacatcaatatcatcatcccaagggataaagcctttgtggcgtattgcaccgattaatgttccaccaccaagagaatagtgaatttggtgtcgctcacataatgcgtggaaataatctaatatattgagacaaacgagttgttgttctctgagcgttaattttttcattatttttcccttgtttggtgtcaatttttgtaaaatgtggtgatagtcatcaaggttatccatttcaaatatatcatcactgttaagttgttnccgtatagatattaagggtaccgagccgaattac

SEQ ID NO: 392 - DNA, 2050 bp, H. influenzae
  misc_feature (1897)..(1897): n = a, c, g, or t
cggcaccggccaaagcccggataaagtgcaccgttttttagtccaacccaagacccgaatgcgcccgtgttagcttgtttagtggccaaggggattccctttgccagtgccggctccagcattaacccaagtgacggaatgagtacaatgcgaaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaaggagatatgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaattgatagcaaaaagcacctaaaagttttaggtgcttttaaagttttaatgcttacaaaattagactttcttaaggtttatagatgaactcaattccttcatcatcttcttcagtccaatcgtcatcccaatcttcgtcatcatcaaattgataccccgctagttgttcctgatgataatcttcccatttgaattttacttcttcaggtgcaacttgttgtgtttcagcttcgcgtggatttgctatgataaagtccataatatcacgacaaagtggtggaacatttttccttgttgcagctgaaatcaggtaatagtcttcttcccaacctaattgttcagtgatttctcgaacccgctcttcagcttcttcatcgctcatcgtatcaattttattgaacactaaccaacgtggcttttctgataatttttcactgtattggaaaagttcagattcaataatagcgacattatctgctggattagatccatcaattggagcaatatcgactaaatgaataagcactctacaacgttctaaatgttttaaaaagcgaattcctagcccagcaccatctgcagccccttcaattaatcctggaatatcagcgactacgaaactgtgtgaatcgtctactttcacaacaccgagacttggtactanagtagtaaatggataatctgcaccttttggtttggctgctgaaacggcacgaataaaagtgaatttaccagcattaggtaaaccgagcattccacatcagcaagtagcattaattccaatataaaccgcggttttcgcccgcgtaccaattgc

SEQ ID NO: 393 - DNA, 1952 bp, H. influenzae
  misc_feature (1668)..(1668): n = a, c, g, or t
tggtatcgaattcggactcggtacccattatggctgcgtttctggatcaccaaaacgacaattaaattcgatcactttcggctgcccatttggcataatcattaatcctgcatataggaaacccgtgtaaacactgccttccgctgccatgccattaacggttgggtaaatcacttccttcataatgcgactatgaatttcgggtgttattactggtgcaggcgaatacgcgcccataccgcctgtatttaaccccgtatcattttcgcccacgcgtttatgatcttggctagtagccataggttctacgtttttaccatctaccatgacgataaaacttgcttcttcgccatctagaaattcttcaatcactactcggctgcccgcttcgccaaaggcattaccagaaagcatatcgcgtactgcatcttcggcttcttgcaatgtcatcgcaacgattacgcctttacccgccgccaagccatccgctttaacgacaattggtgtgcctttttcacgcaagtaagtcaatgcaggttcgacttcggtgaagttttgatattccgctgttggaattttatgacgagcgagaaaatctttagtgaatgcctttgaaccttccaattgcgcagccgctttagctggcccaaaaatcttcaatccagcttcacgaaatgcatcaactaccccaatcactaagggggcttcaggaccaacaatggttaatccaatttgtttatcttgagcaaatttcactaatgctggaatatctgtcgcagaaatattcacgttttctactttgtgttccaatgcagtaccagcgttacccggtgcgacaaaaactttatctgctaatggagattgtgcaactttccaagccaaggcgtgttcacgaccgccgtttccgatgatgaggatgttcatgttgtagtccttgcgtatgcctaatttaaaaaaagtacggctattttttacctgcaattccccctcttttgtaaagagggggatagttagataaattaatgtctaaaatgtcgcattccagtcaataccattaccatattatgttcatccgccgcatcgatgacttcttgatcgcgcattgaaccacctggatggatcacacattgaattcccactttcgctgcagcatcaatgccatcacggaatgggaagaacgcatcagatgccatcacacaacctgccacggtcaagccttcatcctgtgctttgatacctgcaattttggccgaatacacacggctcatttgacctgcaccaatgccgatagtttgattgtctttggcgtaaacaatggcattcgatttcacaaattttgccactttccagcagaataataagtcttttaattcttgttcagttggctgacgtttactcacgacttttaaatcatccacgccaaccatacctaaatccgcatcttgtactaataaaccgccgtttacacgtttgaaatccaaacgttcggaacgagaagtccattcaccacattcaagcaaacgcacatttttcttacgcttcattacttcttgcgcttcagcagaacttttcggtgcgataatcacttcaacgaattgggcgttccacaatttcattcgccggttttttcgtctaattcacggttaaaagcaataatgccgccaaagncagacgttggatcgggtttggtaagcgcgattataagcatctaaaatatccttacctaaagccacaccacacggattaagcgtgtttaacgataacacaagctggctcatcaaattctttcacacattcaagtgcagcatcggtgtcggcaatattattgggagataatgcctacctttgcaggtgattagcccggagccacgctcgcttcttttcacattaaatcaacttagaagcggcattttgttgggaaatttggccatacccataatttgttaacccca

SEQ ID NO: 394 - DNA, 2965 bp, H. influenzae
  misc_feature (2937)..(2937): n = a, c, g, or t
gaaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagacaaggcaacggattgtggcaaattgttatgataattaagtttggcaaagctacctgatttgattttaatggttgggccaagataattaccgttgaatccccataccgtcacattgtgtgagccatctaacggataattcgtttcctgcatggttaatacaatcgggcgaccgcgacgaacttcaattagtggcggcacaactagtttttcacggcttgccgctaacaatggtgctggcacggtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagcttttttacccacacttactgtgcgaggttgcaccatataagagattgttaccatatcataattatttttgatgattaccgatataaatggcgcggctaatttgcttctgatcttgaggaatacgatgttctacctttaagccaaaaagtggatataagcgtccaaaccaacgagcaacaatgcctacgttgcttggatttttaaagcggataaaagaataaatcgtacccagtacacaaattagaatacagcagattaatacgaggaaaattcgaagtagttttaacataaggatgccctatacaaaatttcgttaaagtatagcaaattcaatatcaatatgtgttaatctaaacaaaaatcgtggaatttttatgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaagtgcggtaaagcaaaaactcgttattttacttaatgatactagaataatacttatccataaaatcgtacctaaaagctggtggataagcccaacttttagatacagataaaagtgcggttaattttaggattagttttctttcggtaagcgaagcgacgcgtaaattaatcctccccacaataaagtaagggctatgatcatcataataattgcgccagtagtcattttattctcctttagtttcatcaatcgttaatttggtttcgcttttccattttaagcgagaaaggaaaaatgccacgacaagtaagctaatcgacattccccaaccaaaggtatttacaaaccagtttggatagccttcgtaaccttcagagaagacttttgccccttcgctgaaaagcataaatgctaaaacaccactcgttaatacaatgcataaacgccagaagaaacccactttgaaagatgacgtttcatttaagtgattacccaataaaccgagtttttcatttgctacaatcgcaattaaagacgcaaatgctacggcaacaataccgaaatagttcacaaatttatcgaacacatctaacatcggtaagccagttgttgtaccgaataagatgacagaaactagcatcattggtacacccacgatgaatgtcacttttccacggctaatacgaaatttatcttgaaatgccggaataattacttcgataactgagatgaatgaagtccatggcgcaaaggttaatgcacccaagaataacatgcctagcacttcgcccaagggggcctttggtgagatgggtgggaaagcnaaaaatgctaacccattcccgcctttgc

SEQ ID NO: 395 - DNA, 2748 bp, H. influenzae
tatgctttttagtgcgatcttcagaaaattttccaagactgacaaaaccaattaccattacagaagcttcaaaatacacatgccccattgcatgatcggcgtggtaaaacaacatgaaagcagaataaagataaatagtgagcgttcctgtgctgacaaggacatccatattggcaagtccaccacgaatactaccgattgctccgcaataaaatggaatggctaaccaaagttgcacaatgcttgctaatgcaaattgccaaatcggcggtaacattaagtgatgggagccacctatcataccaagcattccaatcagaaatggaatattgattatccaaagtatgattaatcgccaagggattgatgtattttcttctattggtaattcattggcttgtttgatatgagcagaaaaacctgttttatggataatctcgataatttgagtttcgcttgcttgcgtagcgtcaaatacaacttgtgcttcttcgacggcaaaattcactcccgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacgccatctaattcagttaaaacttgagtaagactttttacgcaacagccgcaatgtatgccttttatgtttaatgtgatagttttcatttttactccttgttagttgttttattgatgaatgcgattggcacaagattggcaggtcatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatgaatgtgattggcacaagattggcaggccatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgattgttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacggataagtgaaaagtgcggttaatattcccaactttctggatcgacgcctaattcacgcataagcactttggcatcttcgggaatttcatcattacgctctttcattaaatctgcatcagtgggcaaaggctgccctgtgaatgcgtgtaagaacgcttcacaaagcaattcactgttagttgcgtgacgtaaacttttcaattggcggcgagtgcgttcattcgtcaaaatttccagtactttaatgggaatggatactgtaatttttttgacttgctcactttttttgccatgttctgcataagggctgatatattttccgtcccaatccgccataatttcccttagagcttatcgataaccttacaaattgtccgtattctaattaaaaatcaaataaataacaatctagacggctaaacttccaaaataagttctaaaaaagtgcgatgatttttatattaaatgctaataaaagctagacagcgtagggttttagtggtaatttatgcgccattcaaagggtgcaagcccaccattcgaataatcaattcttattaattccaacatttattcattatgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttcttcgttctgccgacagttcctaccttgcaggccctgatgatatttatgtttccccaagtcaatgccgtcgttttatcttcaaatggggtaaaggggtaccgagtccgatattcgtataccat

SEQ ID NO: 396 - DNA, 2654 bp, H. influenzae
aacgccaattggcaaaccgcaaaataaatatatggaacttggccctcgtgataaggtttctcaagcattctggcaagaatggaaaaaaggtaataccttaaaaactgcgaaaggcgtagatgtggtgcatttagatttacgtcatcttggtgaaaaatatttacatgagcgtctgccattcatttgtgaattagcaagtgcttatgaaggtgtaaatccagtaaatgaaccaattccagttcgtccagttgttcactacaccatgggcggtattgaagtcgatttcaatagcgaaacacgtatcaaaggtttatttgctgtaggagaatgcgcatcttcaggtttacatggtgcaaatcgtttaggatctaactctttagctgaacttgttgtgttaggtcgcgttgcaggggaatatgcggcacaacgtgcagttgaagctcaatcggtaaatcaaagtgcggttgatgctcaagcaaaagatgttgttgctcgcctagaagctcttcacaaacaagaaggtaatgaatcttggtctgaaatccgtgatgaaatgggtaccgtgatggaagaaggctgtggtatttaccgtgaccaagcaagtatgcaaaaagcagtagataaaattgcagagttaaaagaacgttacaaacgtattcgcgtatcagataattcaagcgtgttcaatacagatgtactttacaccgttgagttgggttacattctagatgttgcacaatctattgcaaattcagcgattgaacgtaaagaatctcgtggtgctcaccaacgcttagattacacagaacgtgacgatgtcaattatttaaaacacacacttgctttctacaatgagaatggtgcgccgcgcattgaatacagtccggtgaaaattactaaatctcaacctgcaaaacgtgtttacggtgcggaagcagaagctcaagaagcagctgcgaaagctaaggagcaagcaaatggctaattcaccagtaatgaatgttgaagtattacgctacaatcctgaaatcgatcaagagccacatttaagcacctatcaagtaccttatgataatcaaacttcattgcttgatgcgttaggctatattaaggataaacttgaaccatctctttcttatcgttggtcttgccgtatggcgatctgcggttcttgcgggatgatggtaaataacaaaccaaaattggcttgtaaaacgttcttacgtgattacagcggccatatgcgtattgagccgttagcaaacttcccaattgaacgtgacttagtggttgatttaagccactttatcgaaagtttagaggcaattaagccttatattattggtaacgaagcaccagcattagatggtaaaccacatccatcgaaagaattgcaagttagccgtactaaacaaacgccagcacagcttgagaaatatcgtcaattctcaatgtgtatcaactgtggtttatgctatgccgcttgccctcaatttggtttaaatcctgaattcttaggccctgcagctattacgatggctcaccgttataatcttgataaccgtgaccatggtaaagcaaaacgtatgtcattattaaatggtaaaaacggggtttggagttgtactttcgttggctattgctcagaagtttgtccaaaacatgtggatcctgcttctgcaattaaccaaggcaaagtggaaagtgccaaagattatgttatctctatgctaaaaccaaaaggctaagggggaaggaatgtcagtacagtgagtaaacgtaaaaaatatgttcgtccaatgacagcgacttggtggcaaaaattggacttctacaaagcttatatgctacgtgaagcgacttcagtctttgctgtatggttttgtattgtattgctttatggtgttctttgtcttgcaagcaatccaatgccaggcttaggcatattgagctttattgagtttttaagaaaccctattgtggtgttcttaaatattattacgcttatcgcaacgctttatcatacggtgacatatttcttaatgacaccaaaagtgatgaatatcattgtgaaaaatgaacgcttaccacacactgttgtaagaaatgcactttgggcggtaaccacattagttagcgtgattgcgttagttttagtttatatttaagggagagaaaaaatggttgatcaaaatccaaaacgctccggcgaaccgccagtatggttaatgttcggtgcaggtggcacagtgagtgcaatttttcttcctgtcgttattctaatcatcggtttgttattaccatttggtttagtcgatgcgcataatttaattacttttgcttattcttggattggtaaattagttattttagtgcttactattttcccaatgtggtgtggtttacaccgtattcatcacggtatgcacgatcttaaagtacatgtgccagctggtggatttatcttttacggtttagccacaatttatacccgttgggtattatttgcggtaataaacctgtaataaaaatgttataataaaaaaacgagtcttagactcgttttaattttatattaagaaaaatttttaagtgggtttacttaaaaatccgatggttttttacaccgctcagcctcctggcctaatttcctt

SEQ ID NO: 397 - DNA, 2751 bp, H. influenzae
aaagcgattttacagccctcgtatcggaaacggtcggggcttttttattgcctaaagacaggcgggagataatatatgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatttaataaaatttttccacacgcagttaaaggtgtttatcaagctatttcggcgcagatagaaaaagcaggttgtgtgaataagatgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaatagattaaaaatctaattgagcggaattaatgccaagtgctgtcgctattttaatgcgagtgcttttacgcaaggtctgtgaattttcgtgttgtgaataagcagcttgagaaatgcctaaacggcttgccacttccgcttgtgttaaacctaagtgttcacgccaagcacgcaatgcagaataatcgttcaataaagctaatttggcaaccgcttctggaatacctgtctcaagtggattggtaaagatgattttttcataaaatgttaataaatggttcatctttctattttataagttttattcaagtattttaaggatttcctatgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgttcaaaagaaaggggtaccgagtcgatatcgtaaaca

SEQ ID NO: 398 - DNA, 2516 bp, H. influenzae
tggtatacgatatcgactcggtacccttttatcctcagctttcatattcgagttattcaagatcgtggctatttgcgcatcaaagttattggtgatttgcatggtgaaatcaatggatttaccaatagtgttcgccgccacttgtgcatttaagttcttcatctcattttgatgattcaaattcgccatatctttttgttgttgccgttcaagtgcggcttgagacgcagtgaattgattttgtgcctgatttaatcgactttgattgctataagctaaatcagattgtaattgcgccattccacgctgatgaccgcgttctaattctgcctgcgatgcggtgaattgattttgttgctgattgagcttactttggttttggaaatttaaatcagcttgtaagcgagtttgtttttccgcaaacgcattttgcgtatcttggcttgcaattggtattgccgcatcaagcattgcacgttgagcagattccacaccaatggttgaattttgcaagccgcgattagctgccatacgttctcctttagcagccgcgctattcattaaaagtgaattgctatttaataaattagagacattacctgccattgtctgtgatgtatcttttgtcggagattgagtggaaattgttggggcttgcggtgttttagttttattcaccgcatccgtcatagaacctagaattgacatatattctcctaaaaaaaaaagaccgcttatttcgcagcctcttgttgaaaatttatttaattattacttacggtggtaaaagcaacagcaagctgattcggactaaaccgccagccttcattgctatttttaatgcaattaaaacaccattcactgcaaaaatattttgatcgtttttgtttgatgccgagcacaatcccgacagcaccccaccagtcgtatttacagcccaaagtgcggtcaaaataggctttgatttgtgcttcggttacaccgtcgagcggaattaaatcccatttttctctatcataaacatcaatttgcttgcaacgtacgccaccgtctcgaattgaagacgaataacactcgtacatcacttctgtttcatagtgatgcccactgacaaatacttctttcattactgcaatttcacaatgcgaatacacgccttttgtcaatttacgagtgagccagtcactcaaacgtgccaaagtgcgttcgggtttttacccgtttttttacctttgtataatgcgagatagattttagtgcctatcattgttgtgcctccgctagttgtcgcatttttgaaacaatatcgtcatgaatgtttttcagttcttcatcactcaacgcctcatgctttaactcatacttacgcattctttgcactgctaattgttgttgcaatgcacgtaatctttctgcttgctgaagaatcaaaagtgacgcagactgattatcaagacctgcaaccgttgcaaaactgctgatataaacgcttacttctccagcaaaatttgcttctttaaaggcaatagcggcagcttctcgctccttatactcttcggcaaaccttatccatctagaactgatgttcgccgctgtatcatcaatgctatcaactagatttttaatgagttcacgcttaatttcagttttctttttttcatcgacaatccagctgtttccgttccatttgtgtaattctgttggttgtctatcaactagaatgtattgacttttaaaataaataagttgtttagtctcaagctctgattcgttttctacttccatttccacaaaatcatttaagttttgcggaatagggaaaatttgataactattcaaattttcttttaaaaaatagactttcattaatcactccttcatcgaatatcaatacgttttacaaaacgaccagcaagttcttcaatgtgtattgttgtaccgtttctatcaacagtcacagcgaattcctcgacttctacatgatacacactagttccaccagaactgtgtggaattacttgacgaatactactaaaataaactccaccgccccttttaccttcaatctctgcccctacttcaaaactgacaatttcaatattgttattatcatcaagcctgtggcctgatgatgactgaagatacaaaataagtgttttaccaaaacacttttctgaaatattaatactcccagaacttacattaccttgccacactgtttttaatgtgccaatttgagataaattcttttgtgcctgcaaaaattgctgatttatatcaacttttgcattgtttatttcttgtaaagtagattgtttattttcttttatttcttggtcaaccctcgcagataacgcttgcatattttgcacaagtgtacccgcatctaaaattcctgcgttctcaacaacgccgaatgctttaacccaaaattgcacgtcatcaaatgtgttttttgcttttatacaaagtttgagaataagcgatttagggcgagtgggtaccgagccgaattt

SEQ ID NO: 399 - DNA, 2994 bp, H. influenzae
cggccgagaaaaaaaaaaaacaggccaagggcggaccccgcgggaagagcgaaagcgggaaggggggggaaattcacagaatggccctttgcccgaacttttctgccgggggattaaaaaggaaaaaaggtcctatttgtggaaaatctcaccaggtgtcccccgttaaaactgatggcaatccaaaaatggcaggtaaaaacaccaaagaggacttgaaaattacccgcaattaaccctggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataactattcagaacacaaggtaaaagcataaagccaatctgacagacatcaattaaattgcatgcctgtcagatttattaatagccactgttgctatattattttaaacatccacgtataaccaatacgccaacatttcgagcttgcgcgacggcttttggtttactcagtttaatttttaatccttgaagttgataacgtgactcaagcaaatccgccacttcataagccactcgctcaatcaacaagaaagatttactttccacataatcaataatcgcttggctcacttcagcataattcaaacaatatacaacatcatccgtttctgccgcttgtttacaatcccacgccatttccaaatcaaacacaagtttttgttttatttgctgttcccaatcatatacaccgatttgtgcaaaaacagtcaattcctcaataaaaacacgatccataagatttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgcctgatcctcgtcaaaatggctcacacaacccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttggccagatccccgaattatgcaaaattaggggtaccgagtccgaatcgtatac

SEQ ID NO: 400 - DNA, 1512 bp, H. influenzae
tctgacgagtggctgagattgaaaaaaaaccccctcaattttgcgatgaaaaatgcgaatgttgtcacggcatttaatattgtgcgtaccgcacttttttaccgtattagagggcaacatcgccatcctcgtacccagagaatgttacgttattattttgctgcgcaagatattcacgaacgcgccaattctacgcattttgattatcaacaaataacggaaaaactaaaaaatacagatttgattttccgtattcaacgtttgttagaactacaagcacaatcctgtaaagaaatcacggcgagtttgcgtgaaaataaaccttatcattttaatgaacgtgtcgaacgtgcgcttttaggcaccttgcattcctttgaactgtatcgaacacaacatctcaatgatcaagatgaactgattgatattcaaaccttgttagataatttacaaagcattaactggcaacttcgccagttagcacaagaaacgacggatacagaacaattagctcaaattcatacggaacaaatcactgggttaaaaaatataagtgcggtgatttttagccattttacgtttgagtcaccgttgttccgacatgcggtacgcttatctattgtggtatttctgtgctgtgcaattgttgagtttttccaatttaatcttggttattggattttattgaccactgtatttgtgtgccagccaaactattctgcaactaaagtacgtttacgtcagcgtattattggcacgatattaggcgtagtggtagggtctctattaccttatttaaatccaaccttagaattaaaacagggtcttgtggtgctcacaagtactttgttctttttcttccgtagtaataattatagtttctcgacctttttcatcacactacaagtattgctcagttttgatgtcatgggatttgatacggcagctgcgttgatgcctcgtttacttgatactttacttggtgccgcgatttcatggtttgccgtatcttacttatggccagattggaaatatttgcaacttgataaagtgagccatcaagcattgcgtagtgatgcggtgtatttattgcatattattagtcaattgcaatttggtaaaagcgacgatcttaaatatcgcatagcacgtcgcaatgcacatcaatatgcagccgcactgagtacaacactttccaatatgaataatgaaccagtgaaatacaaggcatatttacaaaaaggttttgatttactcaaactgaattattctctattaagctatattcagcactgggagcttatcgagacagaatgaaaatttgcacagaccgcacaggtttttatctggttttttatcctggggcaaagaaaatttattataccttaaaaaccattgaagaatacccgagctattttaaccaacgccagaaagatcgaaaccatttaaagaatgggaaaacagactgactgccgaaaacgcgccgtctttgtttccgtatcccaattaatc

SEQ ID NO: 401 - DNA, 2796 bp, H. influenzae
  misc_feature (429)..(429): n = a, c, g, or t
  misc_feature (454)..(454): n = a, c, g, or t
ttacagagggcataatttatgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttgnggtggtaaattctcaggcgtggcanaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgattacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaaggggcatataaacggggtaccgagtccgaatcgtaaac

SEQ ID NO: 402 - DNA, 4021 bp, H. influenzae
  misc_feature (3470)..(3470): n = a, c, g, or t
  misc_feature (3668)..(3668): n = a, c, g, or t
  misc_feature (3800)..(3800): n = a, c, g, or t
cttgctttaaactattttgcgtattcatcacttgcctcccgtaatgcttttgttgcggcttgcacattatcggcgtgcgtaattgcagtaatcactgccacaccatccgccccaaattctcgtaaggttttaacgtgagctaatttcaccccaccaattgccacaagcggtttagttatgcccacatttcgcaaagtttgaataaacgccattcctagtgttggtttcggattctctttcgattgcgttggaaaaatcgggccaattccaaaataatcaatttccgctaaattttccccaatttttgcctcgtctaaacgattcaccgaccaaccaataattagcggtttatctgttttagctcgaatctcttgcacaggcatatcgctttgcccaacgtgaatgccatctgcctcaatttccaacgccaaatcaacgttgtcgtctacaataaacggtacgccatattcacggcacaaatcacgacaactcatcgccagtgccttctgtgctgagggcgtatgttctaacgaaaatttgcctttatcccgaaattgaaagcaggtaattccgccttctaacgcttgttttagcacgaataataaattttccgacaagttctcgcccaaatgacggcaatcttgcgtgcctgccacaaagtaaagcggtaagattttttgaatatttttcatctttcaatccttaaaggcgactgtaagcccaatgatttgtcggcccgtgtccttgcccaatattcaatgggtgagaaatcgcagcggtaataaaatctttcgctgtttttaccgcactttgcaacggttcgcctttcgccaactctgcggttaaacaggcagaaaaggtacagcccgtaccgtgtgtatgcggcgtgttgaaacgggggctttgcaaagtaaaatgacgaccatctgcaagtaaaacccaatcttggcacagctcactttgcgaattgagcgaatgtccgcccttaataataacattcttcgctccttgtttttgcaacgcttttgcggcttgttgaatactgatgtcgtccacaatcgcaatccccgttaatgcttccgcttcgggaatgttcggtgtaatcacgtccgccaacggcagcaatttttggcttaatgcacttaccgcttgctgttgcaataagggtgcaccacctttggcaatcattacaggatctagcaccagcgtgccgaaaggtttatcagcaagaaaatctgccacgcattcaataatttctgcattgcccaacataccaattttgcaacttgcaatctggaaatcatttttgaccgcttccagttgcgcttgaattgttttcagtggaataggggtgaatatcaaatacgcccaagtgtgttttgtgcagtaacagctgtaattaccgatgtaccaaacacgccgcgcatttgggaaggttttaagatcccgcttgaatgcctgcaccaccgccactgtctgaccctgcgatggttaaaacttgtttcacattactcattgatgcgccctctttgtccaatggtttcaggggaaaagggcagcaagctcgtccaacaaacggatttggaactgtcccacttgtgtggttaagccttgcgccgcacactcgcctgcaatggtgtatgctacacaggcttctaatgtcgcagaaaaataatttccttcacttaccgctaaaaaagccgcacacacggcactcaataaacagcccgaagccgtaactttcgggaacaatgacgtgccgttgtgaacggtcgcagtttgtgtgccatcgctgacaatatccaccgccccgctaatcaacaccgtacagccatagcgttgagccactttctcggcaacggcttttaaatccacttcgccttgccctgcatctacaccttttgcctgccacgtctcgcctgcaatggcagccagttcacctgcattaccacgaataagtgcgaattttacttctgccagcaattggcgaatggtctcacggcgatagctcgttgcccccacaccaacaggatctaacactacaggaattccaacctcatttgccgtttttcctgcctgcaacattgcctcccgatctttaccaatcagcgtaccaatattaatgaccaatacttgactgattttcggtacttcctgcatttcttcgatattcgccgacatcaaaggcgaagctcctaatgccaacaagccattggcactaaaatttgctgccacaatgttggtgatgttatgaatgagcggattctgctcacggattttggagagataaattgattgcataagcattccttgtattgaatataaaataaacaaaaatgcccgctattcactgtgagcaattagcggatgtaataaaatgtagaaaattggaaaaataaacaggataaaatcgtgatagagaaaggttgaatatgtggcatattagtttcctacgtcagtgctaactgtttcaggttcacgggtatcatctcagcctttcggcaccccgactaaaaattgcatgaagtttacgcttcttttcaagaaaaaacaagcggtcaaatttttccctcattttgcaaataatgagaagaatttgaccgcttaaatagaaaactaaatttgtttaattaaaaacggtaacgtacaccgaaagaggcttcgtgagttttaaaacgcacgttttctaagcgtccccaatcgttataacgataatctaagtctaaggtaatattcggtgtaatgtcatagccaataccaccaataaaaccaaagccaatgcgttttatgcttctagaacctgatgtttcctgatccgccttcacatctccgcctattggcatattgttagtcttaaatgtaagttttgttgtaaattcatcttttgtgtaaccgctggtagcaacatgcccaacttactctgttttataatataagtaaaaatgttttaattaaagcataaaataacagcaaaatctgactgattggttttttatgctttcaatcaaactgtatttataaaataaaaagaattgacgtaattttggttacgtcaattctatttttatttttgattattctgattttgcgcgggttggttcagaataaacgtggctaattgcacaatgatgtcctgccgcaccttttccatagaaataataacgagaatcctgccaagccctaattgggaaagcctctggcatttcatcatttgctttcgctaaagtcatctccgcttttgtatggggtactgaagaaattgtacctaaacgtccattaaattcataagtgcggacaaattttgatactttctcgagcgtttcaggttcatctacattaattgctggatcaatagattcaacaacttcttgaggtttatatgaacttaaacggtctaaagattcttgtacttttttctgtaccgattcattagctggttgagtaataaaatctaatgcaggttttacatncaggggatttttcttcaacgacaattcccattgctggcgtgataaacccttttttagttttctcttgctcaagcaattcatccacagataagaaatgattttcttttggcagatttaccgttgaataatcaatccaagccttgccacttgccaattcaggcgaaaccaccgcagcaaataatggcattggccgatttntggctcttgattacggcgacgacgctgattattcgctgcacgtaaatgacgttggagtacgacgctgacgctctttgacgtcaaacggttggttctgatgacccgggtttttcatcattattttgaaccgtnattacatccacttctggcattttttcagtcgggctgaagttattttcaacaactgtttcataatcttcaacgcgcacgcggttacgtaattacggcgtggcggggggtgagtaccaggctcaattctttcttctttagcctcaaaaccagggtgagaatttaccgcactttagcgatactttcttcccttaattaccgggcggccggggggtgattaccct

SEQ ID NO: 403 - DNA, 3132 bp, H. influenzae
gagtatttgaaggctcaattactgaccttccaaatgcaaaagcgaagaaaaataattcttattgaagaatttttaattctgcttagattaaaaattccagcctaaataaaaatccccaattggggatttttattttcctctctttctatttttttatgatagaatgccaatctaaaaacgtttcttttttttaccgcacttttgagcattatttatgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcattaattaaggattcgatgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaatacatcaaattgcactcatgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctcccacagaaatagcccagaagaaaattcaagtgatgataatgcagaagttgctcaagatgaacaagaaatcttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtttaaaaatattgtgttttcccctcaagatttccctgccaaatttataaaaccatcagaatatttttattaagctctaccattttgtatgtttttaatctaaaattcgtcaatttgttttttaagagccaaaaggagagtgaaaatgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgt

SEQ ID NO: 404 - DNA, 3496 bp, H. influenzae
  misc_feature (3150)..(3150): n = a, c, g, or t
  misc_feature (3321)..(3321): n = a, c, g, or t
attcatttatgagtaagtttatgcagggaattccgaccacgcaacaaaactggtcgtcatttcctagcttaggtgttccgtcaattcaaattagttaagaggagaaaggttatggcgttttgggatggtgcatgggatgcaattagtggcgctggtaaatggctgggggaaacagctggaagtgcaatggattggatggacaaccataaagcagcaagtaatattatcggtaatgttattgctggtgctggtggttactttgcgcaaaaacaagctggtaaagatttgatcaatcagcaacgtgagttattaaatctgcaagatcagatgaaatcaaaatattcagccgtaccagatgcggattggtcgtataaaagtttgacagtggatgattctcctggattggcaaatggcggtattttgactgaaatgaagaaacgttctgaaactaaaggggctaacaatggcagagttgcatgatagttttggtgagtcaatggaaaaagctggctatgagcgagctagtgattctgattcatccttttccggtggaggtggttggcgagaagataacagtagtgatagttatcgtagtacgtcagatagatggaatgaccacaaatctagatacggaaaagacaaagtctatactgatgcatttaatgagcgaagaaataactctagttggagcggtggtcatagcgcaattagccgaacaattagtgaaaaatatcattcactttctaatgggcaaatgagcgccgccgttcctgaaaaagatcagaaaacactcactggcggtttgtttggaaaaagttactccaatgcgccttattctgaacgcactccttctatatttgatagaaacatacgtggttcaatgacattaaataacggcgatgtatggtcaagcgatccccaatattcatccgttcgagaacgggcggacatcaatagttacgaccgtattaaacggggcgaagaattgaacttaattggtcgtgctgtaggaggcgtttttagtggggtgggcggggcagcaacaacgccagttggcaaaattgctgaaagtgcggcaaattttgggctttcccacgttggggatttatctcgacaattcaaaagcaaccaagagcaagcgtattatgatagcctcactccagaggggaaagcgtattacgatacaagagtagatttcatcaataagtcctataagaatgctcgggaaaaatatgaaacgaacgataaatggattgatagaggtattacagctgcacaagtcggtttatctgctttagggcctcctggtgcaatgctagggtctgggattggtttattaggtaaagcgatcaacaaaaaagacacgatgacaaaatcattacgtgatttaacagagacgcttaactctaacgcattaaataaccacatcgcacaacaaaatgaattagctgaaaaagaacgtcaagcctataaggaatttatggctgggcgtgatttacgcagtgacaatacacaaccaaaaggcatactgaacactatgtataatcgtatgcaaaatatagatcctgataaacaggtcaaaacgagtgacgttcctaacctaagaaattattgggcaaatatcatcgtatcataggagaaattcatgggcattttagattcaatgacacaacaatcacaaccgcagacaacagaacaaagtgcggtcgaaaatccacagggttcacaacaacagggaagtatggcgcagatgtatcaaatgttgatgcaaaattccattaatgctatcgcaaatgttgcgcaacaacgtattcaagaaaaaggtcccgaagaaggtattgccgatttagtcgcaaaagcaatgatttcaaatcttcaggccgcgcaacaaaatggaaaaactattccgccgcaagtgatgatgcaagtcgctaaagatttagctatgcaattattacagcaagttggtgtgccagaagagcaaattgatgatgtattgattgatattttaatgaatgcgcttgagcaatttggcgaagcaacgcacggtgcgttacctcaggaagaagaacagcaatacgttgatatgatcaacaaagtatctgaaatggaaagccaacgtcgtgcgcaagtgcaaaacggtcaatcaaaaccaatgcaacaaggggcataatttatgggatggggtggaattttaggtgcgatgacacaaggattgggaactggtattgtcaaaaatgttgagcaagggtggaaagatgaagaaactcaaaagttgttagattggaaaacggcagaagccgacaaacaacgtgcttttgatagtgaattgcttgataaaaaatacaagcacgagtttgagcttgaagatcatagaacccgtaatgaaatttcagcggcggctgcaaaagctcgaatttcagcacgttattctcatggtggtgaatcagaagcgcaaaaaaatcttcttggcgcaactcaaacgcttggtatttatgatagccaattacattccttgcaagaaaaattgtccgcaacagaagataaagagcaacaaaatgcgattgcagcaagaatcaatgctgtttctgctgaacgcgagaattatcttaaacgccctgatacaatcgctgcatttaagggggctggccagatgggacaagcgctttatatgactggtggtggtaatatggatttgtacaatccgaaaccagtggagcgcgaaacggtagctgaggatgttaaatcttctgtcgctcctcctgtgcgcaatatgattgatgtaaataatctcactccacaacaggcggcagatattgcaagacagaaaagtgaagatgccgctcgtttgcagttttccaaagcgtcagcggatgctaaagactgggcgcaaaaacgtacacagtatcaatcatcaactttcattccgcgaacattctaaaaagtgcggtcagattttcgcatttcaataaaagcaaaaggcgaggttttagccccgccttcttttgcttgtttaacagtaaagttaatgtttacttgaattaattctaacgcatctaatcgtacgctacagttacaaaagcgaagtctttttccacaatagcttttgcttgctcaaactcttatattccctgttcatcacaacagttntcacacaagactataacaccctgattatcacttttcacaatagctgattgattcgcgatatacaacttgcgcttgagcaataaagtgccccaagtgcttctcatcgtgtagataactacctctgaatgaaatacttcaagatgcattgccatctcgataacaaaacgtganggtttgcagagaaacatctaggagtttgcctcacgcgttattctcacctcgaacttagtacttatgtactagaacagatcgggttacataaagaattcatttaaggtattatttagcttacagccccaaagagaaaggactaccaggtttgttattttggctgtggacaaggcct

SEQ ID NO: 405 - DNA, 4744 bp, H. influenzae
atccacttgatattccagcgaatcctgattattcttctttaaatttagcaatggctgtgcaactggtaagttatgaattgcgtatggctttcttagttcaaaataataagaaaaattcactttctttaatagagaaaaactatccaacaacagatcagttagcttatttttttgactacacagaacgtatatatcagtctcttggatttattcaaaatcaaggagttatgcgtaaattaaagcgtttatactatcgtgcaaaattagagaaaaacgaattaaatattttaaatggtatgctaagtgcggttgaaaaacgaattgatttaacaaaagagaataattgactaaattagtcagatatgtaagtattgcgcaattaatttttagggattctttatgaaacttacatcgaaaggtcgttatgcagttacagccgttttagatattgctttaaatgcagatggcgggcctgtaagccttgcggatatttctgaacgccaacatatttccttatcttatttagagcaactttttgctaaattacgtaaagacggtttagtcaaaagtgttcgcgggccaggaggtggttatcagttagggctaccaagtgaacaaatttctgtaggaatgattattgcggcagtaaatgaaaatattcacgtaacgaaatgtctggggcgtgaaaattgtaaaaatggtgtggaatgtttaactcacgaactttgggaagatttaagtttacgtattgaaagttttttaaatgagattacgttagcagagctggtaaataagcgtaatgtaaaacgtcaatctcatcgtgattttagtaatttattagttaatcaataaaaaggataagcagtatattttttaataaaaaagtgcggttatatttagcataatttaggagtgaaaatgaaattacctatttatttagactacgcagcgacctgtccagtcgatgaacgtgttgcgaaaaaaatgatggcgtttctaaccatcgatggcacatttggcaatccagcctctcgctcacataaatttggttggcaagcagaagaagctgttgatattgcgcgtaatcaaatcgctgatctcattggctcagattctcgtgaaattgtctttacttctggtgcgacagaatctgacaacctcgcaattaaaggtgcggcgcatttctatcaaactaaaggtaaacacattattacctgtaaaactgaacataaagcagtgttagatacttgccgtcaattagaaagagaaggttttgaagtcacttatttgtctccagaagctgatggtttaattgatttagaaaaattcaaagctgcgcttcgtccagatacaattctagcttcaattatgcacgctaataatgaaattggtgtgttacaagatattaaagctattggcgaactttgtcgtgcaaataaaacaattttccatgtggatgcaactcaaagtgttggtaaagttgaaattaatttggaagaattagctgttgatttaatgtcgatgtctagccataaactttacgggccaaaaggtgttggcgcattgtatgttcgtcgtaaacctcgcatacgtttagaggcgattattcatggtggtggtcacgaacgtggcatgcgttcaggtacattacctgttcatcaaatcgtaggaatgggagaggcatatcgaattgcaaaagaagaaatggcatcagaaatgccgcgtttaaaagcacttcgtgatcgtttatataatggcttaaaagatattgaagaaacttatgtaaatggttcaatggaacatcgtttagatagcaatttaaatattagttttaactatgttgagggagagtccttaatgatggcgttgcgcgatattgctgtctcttctggttctgcttgtacatctgctagcttagagccatcttatgtattgcgcgcacttggcttaaatgatgaattggcgcacagttcaattcgtttcacattaggtcgttatactactgaagaagaaattgattacacaattaatttaatgaagggtgcggtagaaaaacttcgtgcattatcgccattatgggatatgtttaaagaaggtattgatttaaataccattgagtggtcagctcactaatatttagttgccattatctgacaatggcatttactagaattgaaaaaaggaaagttaaaatggcttatagcgaaaaagtaattgatcattatgaaaatccacgtaatgtgggatcattggataaaaaagatagcaatgttggtactggaatggtcggtgcgccagcttgtggtgatgttatgcaactacaaatcaaggtagatgataatggcattattgaagatgcaaaattcaaaacttacggctgtggttctgcgattgcatctagttcattaattactgagtgggtaaaaggtaaatctttagaagaagctggggcaattaaaaatagccaaattgctgaagaattagaattgccgccagtgaaagtgcattgctctattttagcagaagatgcaattaaagcagcaattgctgattataaagcaaaacaaggctaatcatgtgaaaaagtgcggtcaattttgaccgcatttttagcggtgtttgggggatagatgggtattacattaacagaaaaagcagctcagcgagtgaaagcctttttggataatcgtggtaaaggtattggattacgtttaggtgtgaaaacatcaggttgttcaggcttagcttatgtacttgagtttgtagatgttttaaattccgaagatcaagtttttgagcagcacggtgttaatattattgtcgatccaaaaagtctcgtttatctcaatggcattgagctggattatgtaaaagaaggcctaaatgaaggctttaaatataataatccaaatgtaaaagaatcttgtggttgtggcgaaagtttccacgtttaaggtaataatctgatgttcaatccttttcaaatttttgatttgccagttgattttcagctggatgaaaaagtactaaatgcacgttatttaaaattacaaaaggccctacatccagataattttgtctcaagtagtgctttagagcaacgtgttgcgatgcaaaaatctaccgaagtgaatgatgccttaaaaacgttaaaagacccaattttgcgagctgaagcgatcattgctcttaatactggtgagcagttagatcttgaacaaaaaagcacgcaagatgtggcgtttttaatgcaacaattacaatggcgcgaacaattagaagatgttgaaagccagcaagatgaaagagcattaaatgtttttgcgaaagaaattaaacaagaaactcaatcattattgaccgcactttttgagagtttgaaatctcaacaatgggcgagagcatctcaatactgtgataaattacgttttacccataaactttctgaagaaattgaacgtgtggaagaacgaatttttgaattagattaaatctgggggcaaatgtaatttgcccctacgagatgtgaataaataacactatgcaaactcttgaacagctcactagtccagaacattctgcttggataaccctttcccaatggattgataacgctcgcaatcattgtgaagtaattaaaaaagatcaatccagtgcggagcgtgagctttttactatgcaaatgccaacatcctcgccaatgggtgcagtaatctatgaaacaggtggaattttaattcattatggttggttacgtattttaggttctggaagttttaaattaccgcgtggcttgatggattggaatttcagtaaatcttttagtgagtcaggcgaaaaaccaaaatatttattagttgcagatgatgtgattggtggttattttgcgttaaatggtggttcgttaggcaataatattggaaaaatttattactattcatcaaaagatcttacttggcataatttaaattttacttacacagaatttttagcttgggcattgaatggcgatgtagaggccttttatcaagggctattttggaaaaattggcaagatgatgtaaaacaattagatggtaaccaagtttttgtatttacgcctgatttaaaccaagacagaaaatagcaattgatgaacgtcaaaaacaggaagtcaatattgaaacccattaccaagcaaactttgcagaaaaaaataaatttgatttggcgtattccgtcgcataactagtagaaaaatagcatatggcattattacaaattgcagaaccaggacaagctgcggcaccgcatcaacatcgtttagccgttgggattgatttgggaacaaccaattctttggttgcatccgtgcgtagtgggcaatccgtgattcttaatgatgaacaagaacgcagtcttgtgccgtcagttgttcattatggcgttgaagagaagaaagttggtttagaagcctttgagcaagcctcacttgatccaaaaaatacggtgatttcagtaaaacgcttaattggtcgcagccttcctgatgttcagtctcgttattctagtttgccttatgaatttgtggcgagtgaaaatggattacctttaattattacggcacaggggcctaaaagtccaattgaagtgtcttcagatattttatcgcgcttaaatcacattgcagaacaacgcctggaggtgagcttcggggtgtgattacagtccagctattcgagatgggaccagccgaatcgaaaca

SEQ ID NO: 406 - DNA, 2540 bp, H. influenzae
  misc_feature (2296)..(2297): n = a, c, g, or t
  misc_feature (2464)..(2464): n = a, c, g, or t
  misc_feature (2496)..(2496): n = a, c, g, or t
  misc_feature (2515)..(2515): n = a, c, g, or t
  misc_feature (2527)..(2527): n = a, c, g, or t
actcaagtaaagatgcaggggaacaacagttagggcgtttctgtttccaaatcgataaccacttcgataagcttctgttttagttggatcagtaataatataacgagatccaacaatatcggtcagtcgtgaaatgagttgttgaacagacattttattatcctcttgttataagaattagtagtactataacagaataattcccatttggataaggacattttaggctttaatcggtgtttttttggaattgctctgcatataaagaaaattctctctttatgataggttcagtgctgtatgggtatttcaatcactcaatatcagcaatgcaaaatccgttgaaacctttaaagataaagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattaggcatggtttgtttgaataaagataaattttttaaaatttacattccgaccaaggttggcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagtcctgtaaatgacagaactcagtccttgagctaaataagtctaactttttggggtcagatcatttatcaataaactgatcaaaaaaaccgaacttaatgttcggttttcttcttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtcgtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgcccctctttaccacaaaccccgatacctaaatcaagttctgatttatctgcaaccatagaaatcttttgcatcacttcaatgccactgccaattaaagttgcgcccttaactggtttcgtgatttttcctttttcaattaaataggcttctgaagtagaaaatacaaatttaccagaggtaatatccacttgccctccaccaaagtgcggtgcataaatcccctgttttacagaagcaatcaaatcatcaaactgactttgtccagcaagcatataggtgttggtcattctaggcattggtaaatgggcataagactcacgtcgtccatttcccgttggagcaacgcccatcaaacgggcattcattttatcttgcatgtaaccttgcaaaatcccgtctttgatgagtacattgcactggcttggcacaccttcatcatcaatagttagtgaacctcgacgattttcaatcgtgccatcatccacaatcgtacataacgggnngaaagtcacttgctcaccaatcttgcctgtaaaaagtgaactttcttttacggttaaaatcgccttctaaaccgtgacctaccgctttcgtgtagcaatacgcccggccaacccgcacctaacacaacaggcatcaatcctgcgggtgctgcaactgcacttaaggnttactaagggctgacgaaccgctctttaccanaagtactgctctatatcgncatcacaacttncaaaaccaatcta

SEQ ID NO: 407 - DNA, 2775 bp, H. influenzae
caaaaatatatgacttgggattctgctcgttcaattcgtatgtttggtacaagtaatttgattaatcaagaaacaggtgcaggtattaatcgtttctatgctccaggcaaaaactatagaatgtcagttcagtttgaattctaacctgttgtaaaaataaaatacgagcatttcctgtttagattgagtttgacactcatatactaaacaggaaatgctcattttttattgtgatttgtcagatgaggtttgatcttctacatttgtagtcagattggcttcttatttaaaagattgataattttattggaatatagattgttaataactaagtataaatcataatcaattttactaaatacccacataacttgtttcagaattttctttaaatctttattgaagatgggatcgtgatgacaaattctgtttcttatgttcactcttaaattctttgtgacttttataataaataatatatccttatctttatttgagttttcaaaagaaattattctataagcatacaaaagaggcattctgtgaagctcacgagaattccacaagaaaaacttcttcaaaaaattcccaaaagtgaaaatgtaaactagatatgatttttccatcagtcgcatttctacctaattcttcaactttttctcttaatttaggactttgtctaagtatttgtctctgtctgataccataatgatcatacgaatctattgatctataaatagcatttcttaatgaaatctcatatatattacataattcaagaaaatagcccgctatttcagaattccattcatataaagcaaccatgttatcattaatactttctgaagttttatttttcacatagtttttgtatgtagataatctttccttactaagtgctttttctaaaacaagaaattgcgttgctgataacatataatcctacttatcacttgacatttgaattatttaaccatagactccgccccgacgatagggaacgttggtcactgatagcattatcatccccccctacaatattgagacaaggccacctaaaaggtggcttttgtcatttttaattcctgaaaagcatcgttttcaactaaatcaataatgctacgcaatccataaaaatccagcttttatgctggattttgtttttagcttaggcataatagcaataacttttcatccctaaaaaggattataaatatgaaaaatatgttactgctcagtagctcaaaatacaagaacacaggttatcttgaacacaccctaccttggttacaaaatttcttggctgattatcgtggtaaaacaattgcttttgtaccttatgctggggtaagccgcacttttgatgaatatgaaaaaactgtgcaaaatgcactttccgatttagggatgaatattgtttccgttcatcatggtaaacagcatcgggatattattgaacaagcagatgtcatctctattggcggtggaaatacattttgtttgttaaaacagctttatgaacacaatttgattgatatcattcgtgaaaaagtaaataacggtacgccttattttggttggagtgctggggcaaatgtagctggcgcatctattatgacaactaatgatatgccgattacttatcctccttcatttcaagcattacaactttttcctcatcaaattaatccgcactttatttcaggtaaaatgcaaggccacaatggtgaaagccgagaagaacgtttggcagaatttttactcgttaatccaaccgcacttgtatatgcattacctgaaggttctgcgcttcatatacaaaatgaaatggcaactgtattgggcgaaaatcctattttgtgcttcagtgaaaatatggaatgtggcacatttgatatcaatacaactttttcttattaacttaaagggaacatataatggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttaccacggacttttggatcaatgatgacgtcgggttttttctactctgcaacgattattgaaatgcacaggattacctctcactcaagaacacctttcccctgttccttaccacacgaacgcgacagcaaataggcgcagttgttcttaatcatttctttccgctggcatctataagatatttggtgcaaacacatcggtcgcgtcttattcttttctaattaatttatgtttacatatgatttgtcatatcgcgtcttattattctctgccccttgccccatctatgatacttctttttgtctgatttcttcgaccccacactatttaccttccctcccttttgcccgcctttccttgtcttttctctctttccctcccctccggccctattaccctcccg

SEQ ID NO: 408 - DNA, 4300 bp, H. influenzae
  misc_feature (1229)..(1229): n = a, c, g, or t
  misc_feature (1434)..(1434): n = a, c, g, or t
acgaatcttggatgattagaaaagcttacgaagaaaaagcgaccgttatcggtttaatcaacggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgttgaaggttcagaagttaaaggtatcgttaaaaacttaactgagtacggtgcattcgttgatcttggtggtgttgatggtttattacacatcacagatatggcttggaaacgtgttaaacacccaagtgaaatcgtaaatgttggcgatgaagtaactgttaaagtattaaaattcgataaagatcgtactcgcgtatctttaggcttaaaacaattaggtcaagatccttgggctgcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcaatttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtgtcagctgttgtattagctgttgatgcagtaaaagaacgtatctctttaggtattaaacaacttgaagaagatccattcaataactttgttgcaatcaacaaaaaaggtgcggtagtatctgcaactgttgttgaagcagatgctaaaggtgctaaagttgaattagcaggtggtgttgaaagttatatccgttctgctgattaacaagtgaagtagctattggcgatgttggtgaagcgaaaacactggagtagatcgtanatctcgcattgttcacttatcagtgaaagcaaaagatcaagctgaagaagctgcgcagttgcaagtgtaaatacaaacaagaagatattgttattccaaatgcaatggctgaagcatttaaagcagctaaaggtgaataattaattcacgtaataaggctgggctgatgtccagcctatttgttaggagttattgctaatatatntgtgtaatttattatcaatagatcttaatttaaataatattaaggaagtatagaggatgactaagtcagaacttatggaaaaattgtcagcaaaacagccaactttatctgcaaaagaaattgaaaatatggtaaaagatattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctagagtggatgttcaggcttaattgattaaaatttaattaaaatatttttgattaaaaagtttattttgggttacaaatattttaaaggaaatgaaatgattaaatatattttaggcattgtgatctttattgcgattgtgttagttgcaattaccattggtgcgaataacgatcagattattacatttaattatattgtggcagaaagtcagtttcagctttcaagcctcgttgcaattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgcttaatgatagaattactctttctattattgcctattgctgctgcctatggctggtatatggggcggcgtagtgcgaagaaagatcaagatgacataagtaataaactctcccgagattatgttacgggagtgaattttttactttctaatcaaactgataaagctgtagatttgtttttagatatgttgcaaaagcaagaaatcgaaaatgaaatcgaaagccactcccaatttgaagccgagcttacacttggtaatctgtttcgttctcgaggcgaagttgatcgtgcattgcgtattcatcaagctttagatcttagtcctaattatacttttgaacaaaaattacttgcaaaacaacagcttgctcgagattttatggtggttggtttttttgaccgagctgagaatctttatattttactagtagatgaacctgaatttgcagaaaatgctttacagcaacttttagtgatttatcaaaaaacaaaagaatggaaaaaagcagtcaatattgctgaaaaactcgctaaaataaagccacaagagaataatattgaacttgcgcaatgttattgtgaatattcacaaagtttagaacctgaaagtgcggttgaaaaacgcagtgttttacaaaaggctttgtcggtttctccgacttgtgttcgcgcttctttattgcttgcaaatttagcaatgcttgatggtcaatatcaacaagcagtagaaattttagaaaatgttttggagcaaaatccagattatacgggtgaaattttgtcacctttaaaacattgttatgaagaattaaatcagttagataattttgagttatttttaattcgtgcaggtcaaattattaataatgatgaagtagaactagctctagtcaaattaattgaagaaaaagatggtaagtctgctgcgcaagctaagctttatcaacaacttacaaaaaatccaagtactttaattttccatcgttttatgcagtatcaaattgatgatgcagaagacgggcggggaaaagaaagcttaattttattacataaaatggttggcgaaaggattaagcaaacatcgccttatcgttgtacaaattgtggttatcaaattcataagctattgtggaattgcccatcttgccgtcaatgggaaagtattaaaccggtttcaaatcaagaacataattaattgatactcagtgaggtaacattatgacaagcaaaattattgtggcattggattatgagaaagaagcagaggctcttgctttagttgatcaaattgatccaagtttgtgtcgattaaaagtgggtaaagaaatgtttactacacttggtattaattttgtaaaacaattacatcaacgtaactttgatgtttttttggatcttaaatatcacgatattccaaatacggtagcaagagcagttcgttctgctgctgatttaggcgtatggatggtggatttacacgcaagtggtggtttgcgtatgatggaagaggcgaagaaaattcttgaaccttatgggaaagatgcaccattgcttattgccgtgacggtattaaccagtatggaagatttggatttattacaaattgggattaatgcatcgccaatggaacaagttttacgcttagctcatttaacccaacgggcgggtttagatggtgtagtctgttcccctcaagaagttgaaattttacgtaatacttgtggtaaagagtttaaattagttacaccggggattcgtccaataggaactgattttggtgatcaacgacgtgtgatgacgcctactgcagcaattcgtgcaggttcagattatttagttattggacgccctataactcaagcggataatcctgcggaggttctccgttctattaatgtatctattgggtaatcataaatgtcagattttgttttagtgtattctacagatgtggggcgaattaaagaggaaaaggcttctgtagttcgcccaaaagagacggtgttgtacgtatccaaaaacaaacagtggtaggaaaggtgctggcgtatcggttatactggtttagattatctgacaggatttgaaaaattacctgcagatttaagaaccttggggtgtggcggacagtttaaatggattattggatccaggggaaaacc

SEQ ID NO: 409 - DNA, 3262 bp, H. influenzae
gataatcttctgcgctggattttataaaaaagccccccgggccagcaaataacctttaataaggaaggcgtaaattacaatgcccgtttttttgcatagaaaagaaaaagttgtgggataattaatttctaaatcagtatcattgaaattattaatttttgactgtccaagcaatataatttcagcctcaagtttttctgataaaagtgcggttaaattttgctgaaaatctgagtggaataaagcatcgtcttcacagactagtgcatagctatcttcagcaatatcgttgtcttcaataattttttggtacacagaaaggtggcttaaagtacaaccgatctcgcccttagtgacattacgaaaataatgtgctttaaattgttcaatattaaaaatagaggctaattcatcccaatctttttgcatggtattaatggcagaaaaaatttggaaatcctcggtatttttttgagaaaagaataatttccgacgttgaatatctttatctaaagagatcaaatatttttttaacataaaattattccttataaaatccctttccattcttcaataattttctcaatgccataatcttcactcattaaacgagatttgtctgacatttgttgataaagttcaggattattgattaataaatctaaacctttaaccatttcttcaatattattttgttcacaaagaaaaccattttctttatgttcgactaattgctttacgccaggagaacaattaaaggcaacaataggtaagccaaatgccatcgcttcaataacgactaaaggcaacccttctgtttgtgaaggtaaacaataaattgaactgctttcataataaaaagcaacatcattagtacgaggaataaaattaactgaatcttcaatattcaatgctttagcaagattttttaaattttcttcttcctcgcctgaacccgctattttcaaattccaatctggatatttttttgccaaaacttgccaaacttttaataaataatcaaaacctttataagaaaataaatgacctacagataaaacagttttattttcccattttgctaatttattctttggcaaaagcgtatttggattagcaatactgattatattgttcgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagaaaaaagcataattgcaccatcaaccacaattaaggtatccagctgtaattctttaactaattctcttaattttttagtgatagaaaaatatcttttttcaatgaatatggcaatttattcattgggtaaatattaattttttcatcaacttggaaaaaaggcttgttaccgccaatgctaataaaagaaacatcatatcctgtttagcaagagcattaacaacattaatggaaactcgctccgttccacccgcactttcgatattcataataaagaaaccaatttttttcattttaaatttccttataaatctttaatccaaggtctggaaatgaatcgtaacagaattgccatcttggaatactcgttctaataaaacgaatttctacattaggatgacttaacaaattaaatgcaacagaactgaagaacgtataaataattattattttatttgataaatatttaaatacgtaatcttcaaaaattaattcagattcaacataatttaccccatcaactcgataatcttctgctggatgagggaaataataatcaaaagaaaattgttcttttaatttttttattaatgagatattttcctcttttgtatttaacaatggttgcccaataaaaaatgagacctcaccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgtcaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccataccctaccaaacattacgccaaagaattgttcattaggatgtaattcaattatttttctcgcaattaatacttgcaatggtgtacaacaaagaatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtagctgttgaataactaatttcttttgttttaaggcttcataaaaatagggaataatcgctttattaagtgcttgaatagcaatagaaacaattaaagcaagttgagcccccatagcataaagccctaaatctgtttcactgaatttgtgataaataaaaatacggtctaactgcccttttaagaaaaaacttgcataatgtaaaataagcggtaatccaaatcctaaaatataaaatagtgcggattgataatgcttaaattgatttttttagatgtcgtactctttctgtaaagaaaataagaaaaaaaccaaacgactaaattactcaataaaatgggggtctcctagagtcgaccgcaggcagcaagct

SEQ ID NO: 410 - DNA, 4037 bp, H. influenzae
aggacccccaactctatggatcgcgatttacttatccaacatttaaaaaatctaaaaaaggcagtgcagtagatgtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaataggaaatcttatgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaataatcaatgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactttagttctccaaaaagagttttaaaagtgcggttaaatctgtctaagttttatttatcttgcgtttaacgttttgctttcttaataaacttcatcaaacgtttacgtttacgcaattgattcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaactactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagctcagatttcacacgtctttcactctgatataaaccatccctttatcacgacgatcaccaggtacgagccgaatcgaaca

SEQ ID NO: 411 - DNA, 3318 bp, H. influenzae
  misc_feature (3281)..(3281): n = a, c, g, or t
  misc_feature (3291)..(3291): n = a, c, g, or t
gagaccccgggctaagcccccaaaatatcacgattgtttgttggtgggctaaagcccactctacaactactaatcaacaatcaacggctcgcattataggaaacaagcaggtttaaatacagaaaataataagaatagtttttatttcttgatttttatcaaaaatcaatctttattgttgtgagaaaatgcttcctcgtataatatatttgagaattattattatttttttataggattaaatatgaccaattttagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaactagaacaaataaatgtatctggctctaccgaaaatactgatacgaaaactccgccaaaaattgccgaaactgtaaaaacggctaaaacgctagaaagagaacaagcaaacaacattaaagacatcgttaaatacgagactggcgttactgttgttgaagctgggcgttttggtcaaagcggttttgcgattagaggggtagatgaaaatcgtgttgcaattacggttgatggcgttgctcaagcagaacattatcttcccaaggttttaaagacctgtttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagattaaattctattacttttgcaggaaaagcaagtatattcgatgtacttgctgtcggcacttggcgtaatggtcatgaaatcaaaaattatgattacaaatctgcagacgacattctaggaaaactcagagaaaagaccgatccttataataaaaaagaccgcagtcttttattgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatagacttgggatggggatnctatagagtncgacctggcaggcatgcatagtctggc

SEQ ID NO: 412 - DNA, 2035 bp, H. influenzae
atgtttgcttatatcggcctcggtatcccgcttttaatctctctcgaaattttgtcatttttgtactcccatattttaaccagtttggatctacacctaacgcattggcaatctcaagaatatttcttggtttttgagtttcacctttcacgatattactgatcgcaccttgggtagttcccaccatttccgccaattctgcttgtgtaacattcctttcaatcagcaaaaatttcaatcgctcgcccaatgttgtcatatttactccctttccctttctattttattttatagatatttctatagataaaaaaatagatttacctatttataaatagtttattttcctttagaatagtaaaaactttatttacttaataggaaagactattttgatcaataaaacaattaaaattgcgattgatgaatgtggtggtcaagccaaattagcaaagctgtgcagtgtcgcacagcctacggtttttgcttggcttcaccgtggtggtattagtggcaaatacatcccgcttatcgccaaagcatccaatggaaaagtcaccgaaaccgacatcttgcgctcactcacaaagtcacaatagcgcaacgaatagtaaaaatcttcaagaaaaaggaaaggttttaatgaacagtaaagacattcagcgcacgttacatcgcgattgtaaaaacgcatctggcggtatcactacgctggcactcacgctaggcaaatcgccgaatattttaggcaataaacttaacgtagaatgcgaaaacaatcatctcagctttatcgaagccctcgatctcatcgaaatcaccaatagcacgcgcaccgtcgccgccattgccgacaaaatcgatcatcttatcgtacctatgcccaaatgcgccagttgctgcgccgatgtcgtgcaaggctttttagacattaccaccaatgcagggaaaattggcgaacaaatcaaaagcgcagtccatcctaattcagatttagggcgcgagttatccaacaaagaaaaacaaacgatttccgccagcattgacgcgctcattgaaagcgcattgtgcttaaagtgggaattagagcaataaaaaaaccacggcgggaaccgtggctaatcattaaggaatgtatttatggagaatactaatccaaacgaaaaaataagtcaatcgcaatgtgaccgtattttgcgttatttgcaatcaggtaagcgactgacatcactcgaagctttagacaaattcggttgcttgcgtctttcggcgcgaattttagatttaaaaaaccgctggcatcagatttcggacgagttcgtccacgatgcacgcacaggcaaagtatataaagcgtattttatggcggtatgagatgagtgttgagttaatgactaaagcatttaaaagcaaaaccggcaatcctttaacaaaattagtgctggtaaaattagccgataatgcgaatgatgatggcgtttgttatccaagttataaacgtattgcaatccaatgtgaagtttcgcgccctacggcaatttcgcacgttaagaaattggaagcgatgaaatatttatccattcgtgaacgtaaaaccgaaaacggcaacgccactaatgtgtatatcttgcatcccgaaaactgggaaatattagagccttttactagtaaagcagctttaccacccctagtaaacgagcttaaccaccctagtaaagcagctttaccacccctagtaaacgagcttaaccctgaaccatcaatagaaccatcagataaccatcatattaaaaaaactacgcaaaaaagcgaatccgaaatgttgcttgagcagttcggtattaccggacaactggcgaaagattttatcgcacaccgcaaagccaaaaagggcgtaattaaccaaacgcaactcaaccgcctgcaaaaacaagcggacaaggcggggatttcgatttgtgaagcggtggagatttgcattgaacgcaactggcagggatttaacgcatcatgggattggcgtgatgaaaaactg

SEQ ID NO: 413 - DNA, 2996 bp, H. influenzae
  misc_feature (2907)..(2907): n = a, c, g, or t
  misc_feature (2909)..(2909): n = a, c, g, or t
  misc_feature (2918)..(2918): n = a, c, g, or t
  misc_feature (2926)..(2926): n = a, c, g, or t
  misc_feature (2975)..(2975): n = a, c, g, or t
ctgccaccacagaacctttatcacgcaataattgcggatattggtctgcatgttgaatgtcaaattctttctcgcctaagaagcggtgaccgcgaatggtgcgagcacttgccacacctaaaatttcgccttcgattaactcatcacctaacaacatagtcacagtgtgaactgggcggataaattgcacggttttatctgcccaacgcattggttttggaattggcaatttcgctaacgcatttgccacaatatcgttaagtaagtttttggtcggctgacctttaatttttgtacggtgaacgagccattcgcctttatcagttgcaatgcgttctgcttgctcaacagtaatgccacaaccacgcgcccagccttctgccgctttagttggtttaccttccgcatcaaaggcggctgatactgcaggccctcgtttttcgatttctttgctcggttgttgggttgctaagttcaacacttttacggctaaacgacgcggtgccgcaaaccattcgattttatcgaatgataaacctgcttgattcaattccgcctcaacgttatccgcaaaagaggtcgctaatgttttgagagcttttggtggcagctcttctgtgccgatttctacaaggaagttttgggttgtcattttgttttctctggtaaggtgcaacttgctgcattgattacttatttacattttatctatcacatcattaatattttcaataatatattcatgattttctaaaatccaaagaagagatttaattcttgtctgattatcatacttattagttgtgaatttaccataaaagttaccttcattatcaacaatcactggcccacttgtagaatacttattccaaggactttcactgttatacttagagccataagttccgtatttattccaaatactatcgctattatatttagagccgaattcaccatatttattccaaattgatgagttatcatgtttactacagttcaaacagcctaaaaatttatcatgattatctccaccaaaaagcaaatatgctggtgctgcaaaggtatttattgataaaaataataatgggggtaacaaaaatttctgtaatgtcatagcattttccttagattaatataattgattcaatgtggagtgagaattttaatagctcacacacgatttaattgttttcttcgtttaacttctgccacaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataggcttccgccacgcctttggttaaggcacgaatgcgtaaaatatagcgctggcgttcggtgaccgaaattgctttacgcgcatctaataagttaaagctgtgtgctgctttcaaaatacgttcataagctggcaatggtaacggtttttctaaggctaataactcttgtgcttctttttcgtattgatcgaagcagtagaataagaaatcggtgtttgcgtgttcaaagttataggttgattgctcaacttcattttgatggaaaacatcgccataagtggttttgcctaatggaccgtcagaccaaactaagtcatacacagaatctacgccttgaatgtacatcgctaaacgctctaaaccgtaagtcacttcacctgttacgggtttacattctaagccacccacttgttggaaataggtaaactgggttacttccataccgtttagccatacttcccaacccaagccccatgcacctaatgttgggttttcccagttatcttccacgaaacggatgtcgttttgtgttggatcgaaaccgagcatttcaagcgagcctaaataaagttcttgaatattatctggagaaggtttgatcactacttggaattgatagtagtgttgtaaacggtttggggttttcaccgtaacgaccgtccgttgggcggcgtgaaggttgaacataagccaatgccattggctctgggcctaatgcgcgcaatgcgggcattgggtgagaagtacctgcgcccacttccatatcaaaaggttgcaccatggggcagccttgcgttgccccacattcttgcagggctttaaaaatactttggaaagtctctacgttaaaatttcccttataaacccccgtttaaagggattaaaaaggttngnttttatctngacccccncccgcgttaccggtaaaatgccccccaaatcagccttccacaaatttancgcgtgttcccccccccctcg

SEQ ID NO: 414 - DNA, 4255 bp, H. influenzae
tggttccgaaaatcggactcggtacccttatcttccgttaacggccttttcctgtgatattacgtaaggttttggaaggcgatccgataaattctcaaacatggctaacaatcctgtttttcttaaaaaattgtgctgattataccgaaatttaggcgtttttcatcatttcaaatgaaaatggatttttgagtaggcaatttcatgaagaaagcataggagataaggaaaaagaatgattatttagccaatttcaggtattattctgcccactcttggctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccgccaaattgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaccgcttaaatatacccgatggttagttgtattcatgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgattctggcgtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcattaaaatgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtgtaacactaaaaacagtgcaacaaaaaagccgacatttgtcggctttctactattcttgtgattttttcttgaggtattcataaagctcatctttaatccgtaatttttcttttttcaaataacgatttccattttgtaatcaattcattatttaatgtttggcgcgcttgattattcacataacgaatgtattccacaaaaagttgatcctcttctttacgatcaaaagaggatagaattaattgattaagattattttcttgagaaaacttaaaatgtgaggcaatttgctgaacagtttcattttcaactttagctctcgctttcacaaaatcagattgatttaaaaaagccactaattgagcggatgaagtaagaatttttgtaaattcatgatacgcagaatctgtcgccttacgctcaatttttaccatatcgtcggcatcagcatcaccactaactaaatggggcgtggattctaatacaaagtgcggtcaatttttctttatttttatacgttggcttttaaactggtttatttgaagaaagctcgttagaataagattgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttattagggggtcccctagagtcgaccgcaggcagcaagtctggc

SEQ ID NO: 415 - DNA, 2912 bp, H. influenzae
  misc_feature (2906)..(2907): n = a, c, g, or t
acatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctagaattaaaagggcgactggcaataaccataacaacgccgtattccatttgaatggcggtttgtaattcacaaaatcaccaaatctagccgtcattttatcgataatttgctgattgcttttgccctcatccaccattttgtacacttcaagacgcaagtcataagcaattggagaattagattccaccaaattttggttttgacattgtgggcagcgtaaagattttgccaactctacggcacgagtacgatcatcttgattttggaattgataggtatccaccatttccgcttgagtaaacaaggaaaatgcgaataaaagtgcggttgcaaaaacaaatgttttttgaactcgagtaaaaatatctaataggcttttcatttattcttcaatgcttcaatttttggcaaaaataccgtttgccaagtttctttatccaataaaccagaatggcgataacgaatcacaccattttcatccacaagataagtttctggcgcaccatccacgcctaatttgagggcaagttctccctgactatcatcaatagttaagatgaacggattgcccattctcttaagtatttcaataccattttgcggattgtcgcgataatctacacccacaataggcaacgtttttgcaatctcaattaacaacggatgttcttctttgcaataaccacaccaactgccccacacatttaataaaaatggctgtttaggaaaatctttcgggcttacgatttgtgatggatcatgtaaattagcctgataaaactctggaacgggtttatcaattaaagccgacgcaatttttttcggatcttgatttaacccagcaattaataatacacacacgcctaaaagcacaaagagcggtgcaaaaaagagaagttttttgttcattatttttcctgttttctgcgtaatccgaagacgctaaaaagtgcgccaaaggccattaaaataccgcccgcccaaagccaacgaatcagtggtttataatgtaagcggaaagtaaattcccctttgccgagagaatcgcccatcacaatatataaatcgccccaaaaaccgccattaagccccacttcactcattgtcattgtacgaacatcgtaataacggcgttcggggataatttctgcataaggtttaccattttcagttacgtcaaaaaaggcgacttctgccgtaaagtttggtccgatttcattagaaaattggcgatagtgaaattcatattgtcccagcgtttgactttgttgcggtgctaaacgcacaccaatttcactgccaaaataaccactcattaccgcaccaatagttacaatcgccacgccacaatgcgctaaaatcataccaaattgagacaaacgaatttgtcgccaattttgccataaagtgaccaacaaaagccaaatcgcaagagttaataacacaaaagcgaaagcgtgaaaattcaacgcagaattatggcgtagctgttgccaaatcattaggcctgcaagaattaaagacggaataagcaaccacccacaacgtatcaataatgtgcgatcaaattgccccttacgtatgctaagcacaattaccattaggattaaaatcgccgtaataatggggaagaaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaggcgtgcacagaagtgagcgcgccagaacgaacaataaacgtgcctaatacgctaaaggcaaaagcaagcagagaaaaaagcgttgtccaataactaaatacgccttgtttttccgtcgccattaaactgtgtaataacgctaacccaagcaaccaaggcattaaagacgcattttctacgggatcccagaaccaccaaccgccccagccaagttcgtaatatgcccaccaagcaccaagcacaatgccaatggttaaaaacaaccaagaaaccaacacccatccacgcattgagcgggcaatttgtcgtgcagattggttataaatcaacgcactcaaactcattgcaaaatttaccgcaaagcccacatagccaacatataataaaggcggatggaaaattaatcccacatcttgcaacattggattgagatcgcgcccttctgcgggagcagggaaaatgcgtccaaatggattggaataaaataaaataaacaccgcaaaaccaaagcaaatcaatcccaataaagtaaaggggatnncttta

SEQ ID NO: 416 - DNA, 3833 bp, H. influenzae
tgaagggtgggggcgagaaaaacgagaactcgtgagagacggcgatacagaagaagcggagaaagagcgggaagaagaaagagaatgcggcagggagggaaggaagaaggcgggaaggaaaggaggggaggaaggaggaaaaaaagggggcggaaaaaaagaaaaaaggggaggggaggaagaaggaggaggggaagaaaaagggagaggaaggaggggggaaaaaaaaaaacgcgagaaaggaaccaggagaacaagaacggagagaaaaaacagggggtaaagaaggcgggaaaggagggaaaaaaggataaacggggaacggaagggatgaggggaagaggggggagaataatgggacggaggaagtgggggagggttctccaaaggcaaaattgcgtacaatagcgtaaccaaggggctgagagtacgttaccagcaaaacaatcgcctttttcagcaagcattgcttgagcaaaataaattaatccatatcccgttgcttccggacgaattaaactaccaccgaaagaaagaccgcgaccagtgaaaacacaggctgattggtttgataattttttcatatagccagctaaatagccaacttcgcgcccaccaacacctatatcgcctgcgggaacatctgtatcagctcctacgtgacgataaagttcagccattaatgcttggcaaaaacgcataacttcagcatcagatttgcctttaggatcaaaatctgaaccgccttttgctccgcccataggcaatgttgttaaagcatttttaaagatttgctcaaaacctaagaattttaagatagataaatttactgatggatggaaacgcattccccctttaaatgggcctatggcactattaaattgtacacgaaatgctctgtttacttgcacttgccctttatcgtcagtccacgccacacggaattgaaatgcacgttcaggctcaactaaacgttctaataatgcttctgaacgatatttaggattggcttctaaaaaaggccaaattgatgtgaatacctcgcgaaccgcttgtaaaaattcaggttgataaccatcgcgttgagcaacttttgttaaaaatgcgtctaaggaagcaacttttgacataatgaatttccctctttgttgatgttgtgtgtattgtattttttattgtatacgcctcgtgaagcgcatagacaatatgcaatggctaatttaatcttgcaaccatttttataaaggaaatttaaagaaaaggaaaaagtaaagaaattatctaaaaaatatcgtatttattagataaaaaataaaaaacgacagaaaaccatcaggtaatgatattttcaataaaaatatagagcagactacaaatcatatttctagtaaatcactacgaaaatatgttttatgaaaaaacaaaattagggttatatcaatataataaaaacgggggcaaagctcccatactattaacaattaagttcatcattgtgttttttctgattcatcattatttttaaccgcactttcgtcgtcttttggttgataaaatcgagcgaccaatagaccgagctcaaacagcaagcacatcggtatggcaagcaaagtttgtgaaaaaacatcaggaggcgttaaaagcattccaataaaaaatgctgcaacaataatataagggcgtttttcggaaagagcctttacagtggtaataccagtccagcaaagtagaataatcgcaattggcacttcaaaacaaacgccaaaagctaaaaataacgctaaagcaaaatctaaataactactaatatctgttgcgatggtaacgccttctggggctgtttgtgtaaagaagctgaatacaagaggaaagacgacatagtaagcaaaagcaacacccgcataaaataaaatcgtactggaaaatacaacggataaatcatccgtttttcgtgctgatataaagcaggtgcaataaaagcccaaatttgataaagcaaataagggacagaaataaaaattgcaacaatcgcagttaatttaattggcgtaaagaaaggagtttgaatattggttgcaatcattgttgcgccttttggcataacagccgttaaaggtgcagcaacaaaatgataaatatcattggaaaaatacaccaaagcaacaaaaaccaacactacacaaatcacacagcgtaataaacggtttcttagttcaacaaggtgcgtaattaaaggttgagattcatccacattactcataaaaactcgctatgatttagtttttgaagattgagattttgacgctggagcgatttcaatatcatcaggaggataatagctagataaatgtgtgttcagttctactttctcgtgagtttcaagtgcggtcaaatctgtaggtgttttttctgcttcagataaagtttctgcagcctcctcaactgagattgcattttgaggtttttctgcattttcagccgcatttttgatttctttgatttgatcttccaccgttgtaccagcttgagctgctttatcttctagctccgctttcatcttatctgcttgagcttttaattcttcccaccgttttactcaattctggtgaaagggcttgcaagttaagggattccgcttttttaatactatcttgtaattcttgcaattttagctcttgtttcaactcattttgaacgttagcagctaaaccacgaattgtttttacccaatccattacagtgcgaattgctataggcaaacgtttcgggcctaatacaaccaatcccaaaaccattagtaaaataagttctgaaaaaccaatatcaaacacggattaagcctgctctttctcttttatattttctttttttgcagacgctgtttcattatctatagacttaaattccgcatcttttactttttcatcttctttcatcgcctttttgaaacctttcactgctgcaccaagatctgagccagcatttcttaattttttcgtgccaaaaatcaataaaataacgactaataaaataatcagttgagcgggggataaaccaaacataataaactccgttctgtaaaaaagaaaaaatttggctcggaatatactctttttagccatttagaacaatagctataggagattatttttatgttatcctgatcttgatcacaaaacctgatttttaacttattgatgtaataaaaaagttaaaatttatctatctctaaaaattgtatttttcttctaattctgtgatgtgagcacttttatccttttagctcgtttcaggaatttgcggtaaattcacagcttttaccgagcctagtgctttcgctttttggtaaaacgctaatttgtattcaagcaaatctaaataacgttttaattcggcaatttgacactttacattttttgtttgattttcaaataaggaaaggcgttcttcaatagtatcgtcgccaatgatggtacattctgcaaagcgtttgatgtcttttaagctcattcctgtatttttcaagcattgtaataaactcaaccattgcaaatccttgtcggtaaaacggcgattaccgtattcatcacgtccgacattaggtaacaagccttctttgtcataaaagcgtaaggtgtaggcggaaatgcctattttttcagcagctttagcggtggtgtaagtcactttttattccctttaaacaaaaatggtaaaaaaacacttgctttagagtgaactctaaagtgtaaactgttgctatcttgcttacgtaaggcaactttgtcaatggattaagaggaaaaacaatggaaattaaacaaatcaactca

SEQ ID NO: 417 - DNA, 4463 bp, H. influenzae
  misc_feature (4164)..(4164): n = a, c, g, or t
  misc_feature (4169)..(4169): n = a, c, g, or t
  misc_feature (4196)..(4196): n = a, c, g, or t
  misc_feature (4213)..(4213): n = a, c, g, or t
  misc_feature (4216)..(4216): n = a, c, g, or t
  misc_feature (4225)..(4225): n = a, c, g, or t
  misc_feature (4247)..(4247): n = a, c, g, or t
  misc_feature (4252)..(4252): n = a, c, g, or t
  misc_feature (4292)..(4292): n = a, c, g, or t
  misc_feature (4354)..(4355): n = a, c, g, or t
  misc_feature (4362)..(4362): n = a, c, g, or t
  misc_feature (4381)..(4381): n = a, c, g, or t
  misc_feature (4427)..(4429): n = a, c, g, or t
  misc_feature (4436)..(4436): n = a, c, g, or t
ctttatacgaatcggactcggtaccctgttctctttccaaccccttgtgttttcagaaagatatcatcgcggtaacgttccccgatttaattttcttcattaaagcattcgtaaccaccgcaattcctttagccttgcctttttttatagcttcggcaaattctgcattatcttttttacgattttgaagcgttctctctgaaatacctaagctatctgcaatttgttgattagtaagcccctgagcggcaagactttcaaccattgataaatctatctcaatcttaggttttgtttttttcttactcatagctggacattcttacacattaaagtacagttgctaataatcactaaggagataaatatgatgaagaaaattgatgtattaaaagatttgatggctaaaaatgaatggaaaaaagcaatctcactagcaagtaaatttcctagattgggaaatgctaaagatgcaattaaatcagcgcaaatggcttacacaaaccctaattttgtccgccagataaaaaaagaccccgataagttaatttatcagggcatccaagcattgattgccaaatacggttaattgtcttcattcgggatgtacacgtctacatctccacaatattcagcagcaattttaggatttcctttcacaaagaccaagacattctgatgcacctttcctatcttgcggctacctttaaaaggcgtagccgcacgcataggcatagtcccacatacattaactaaaatcatttcattatagtagcttaaaccggcttctaagaaagcctgaatagtatctcctacgaaattatagtaattcccttttttatccctaacttcaccgacaacaaaacaagcaaagcgattatctttcaacatatcacaagattttttgataatttcaaaatacgcttttttaaaattatcataatccatattagataaatcattagggttattagaataaacttctagatcggcataagggggcaactaaagactaaatcggcggagacaccattagctaatttatcaatatttatgctatcgccacaaatccatataggctgcaactcatcattagaacaaaccaagtttcgttgcttcaaattagcttcaatttgctcggctctaagatcaacaccgatataatttctatttaatttactagccacaataccgcgaacactaccacctgcaaacggatctaaaatttgacagcctttagggctaaaccaagaatacagtatttcacaaagcacaggatcaaatattgaatcatcgctttcagacattgaagtatcttctttcgagttataccttgccatactgttcataccgcgctgcataccgctatcgcgacctgaaccgctatcaatacccaaggctttccattttctttttctatcctgccaccaaccttctctagaatttaaaattgagaaagggggggctaaaaacgcctgtttaagatcaagtttttccttagaattggaatcaccgcttatatcagccaataaatcaccatctaaactttttaaaaaatcatcatcaaagccaagcaaatcaatatcaaaaccgagatcttttaattcatttaattctaaacttaatagctcaaaattccagccggcattcaacgccagtgagttatcagcaatcacgtaggcttttttctgaatatcggataagcccgttaatctaatcgtcggcacagtatataagttcagttttattgcggctaataatctaccgtgacccgctataattccattattctcgccaatcaaaattggatttgtaaaaccgaactcttcaatgctttcacaaatctgatcgatttgttcatcagaatgagtgcgactattattgacataaggctttagaacatccgtagaaatatattcaatatttaaatctttattcatcatttatctttctaattttccgccgcactttcccgcgccttcacatactcccgcaccccgtccaccttattcgcacataaccgcaattcttgcttgagcaataacgcatattccaccgtctccccaaaggttgaaccgtggaatgatggaatagggcagggggcaagcaaactcaccggcggcgaaaaggcaagcgtgcggtattcaatttctggcttacttgcgcaactcgtcagcaacaccgttaggcagtacagtacggctgcactgattactttccagtattttcttaatggattgaatttgcgcataactttgctccctgattaactgctcttgcgctaaccgcttttcggcaatctttctttgctcgtccacatcttcgtgtaattcatcaataatcttatcccgcttaatgactttttcatgcagagaatcaataacagctgattggcgttcaatattgagcttatttgtgtgctgcatataaagcaacgcaagaataaacactcctgcaaatacagcgacaactttattgaaatgcttgcaaccatgactaaacacgttaagcccaagtttttttataacaaatagccaccacgtcatggatatacactccgtaataactcaaaatgcggtccatcataaaaacgctcatcattagaactctcattcatattccaatcaccgccccagcgaatagcaacgcccaattgtttagcagcttgaaacatagcactggcaacattcttaaatggctcgcgatcattccaattcactggtaacggcactaaatccaccgcatgaccagttaaatggcgactattcattgtctttgtcgctttcttggcaaacaattctttttgtcgctctaacgtgcgtttaccctcaataactttaaaatccaccacacttaattcaattgcacggtgcaccactttcactaaatccgcgtgaacgcctactagtttttcttcactagcagcagatagcttaaatttgctcatctttaatccccaatttagacgcaaagaacccccgccaaatggcattaagcaccgcgccaccaccataaccagaaagccctgagcctacataaactaaatcgctatcaagaccggaagaaagacaaatcaatcccccaatccaccccgcaaacatagacacaagcacttggcataaaaaaagccccacgctaaagtggagctttcccgcttgaatatcgcttgcgtattttgcaacgccggcaaataatccgataaaaaccaatgggagccagcgtaaaaaagattccaagttagtcggatctttagtcggcataataaaacctattttacagatacagaaaagccccaagcatttctgctcagggctgtaaatattttttgtgcgttctcaacgtgctaaaaccgcactataaataaaataatacacctaatagctagccatttcaaggattttttgaaacttttttaggggaactcaaaaaatttaggggaaatttccccttttcttataaatcctctgcaacaatagaaaattttcgcacgcaacgacccagtacgtttaaacgtgacaaatcatcaatttcaaagctcgatcccacgcgctcattctccgccaccgcatttaatacaccgctcggtgtttgatataaacgacgcacatacaactcattattcattacaaacaaataaatcccttcgccagcatattgtttacaagtcgtatccacaaacatcaaatcttttttattaattaccggcgacatactctcattaaacatcgttatcatcgccacgttcgccgtagagcgtaatttcaataaatccatcatcccatcttgcgaaaggtgcaaagcttcaaaagggcgagggaaatgcacattaattatatctgtctcagctaaacgatttacatctaaggcaaaaacccattcttccgttggcttcgtttttaatgaaatctgctgcttatgcaacatctcgcgtaattcatcacttccactgtcaaaaaaattattgacggtctgcccctgattgttattgatctgagaattttccaaagtggaatgactaacggtcatatcgccatacaacaaataatccggcgttgtaccgagctcttttgctatttcaacaattttgcgtggatttctggtttctccggcaaggattttctgcatagagggttgagcaatgccgatcatattagcaattcgggnttggnttattcctttttctaccagcaacgctnttaatctctctgataanttntgcattttntgtactcccatatttaaccagnttggnatctacacctaacgcattggcatctcagatatttcttggnttttttgagttcactttcacgatatactgatcgacctggggtagttccaccattttcgcatnnctgctgngtacattctttcatagcanaattcatcgtcgcccatggtgctattactccttccttctatttatnnnaagaatncatagaaaaaaagattactttataaaa

SEQ ID NO: 418 - DNA, 3068 bp, H. influenzae
  misc_feature (3040)..(3040): n = a, c, g, or t
tgtttacgattcggactcgtacccagcgtgatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaggggtctcntagagcagaccgcaggcagcaagctggc

SEQ ID NO: 419 - DNA, 2244 bp, H. influenzae
gccagacttggctggcctggcaggtcgaattcttaaaggatccccttttccccagcactataacagtgatgactttttatagatatttttaaagtatgaaaagcgcggtaaaaattttatgcaggaacgcgttctgttacgagcatttgtagttttcgtaaaataacatttaatactacgccataggctggtacgaataatataatgccgacaaatagcttaaataggtaatctacaaaaccgagttgtgcccagtgttcagccatgaacggatctgcactttgatagaaggctacactgaagaaaacgaatgtatccgccattgagccaaatgtcattgagctagttggcgccacccaccaagtttttaactggcgtaagcggttaaatacgatcacatcaagcaattgtcctaccacgtaagcggcaaagctcgcaatagcaatacggaatacaaacagatcaaaatgcgttaatgattcgaaaccttggaatttgctttcagagaataaaacagatatgacgtaacttacaataagtgcaggaaacatcaccacgaagatgatttttctcgcatcttccgcaccgaaaatgcgtacggttaaatcggtagctaaaaagataaatgggaatgtgagcgttccccaagtgctgtggaaagaaaaatcgtttgctgcaccaagtgcggttaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggctgaatatagggagctagatgatacgcatatttctaataattgcaagagtcgattgcatttgagttttatattttatgaaaattgacgaatgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttagtaaattgagcataaaataaccgcactttagttgtatcccaaaagtgcggttaattttttctaaattttagcgtttagctttatttattaatgcgtgctagtacttgttgttgtacgatttgcacgtttacgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtaggggctaaagcttgagtaaagtaagcctgtaccagaagtcattgtcataaagttctccacgaaggccatccatccacgactaggggaat

SEQ ID NO: 420 - DNA, 3014 bp, H. influenzae
gagaccccgattgaaatactcgaaaacgaccgcactttatttgattggtgcagtaaacaaacttatatcgcccttgcaaatatgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtggggtaaaaatcccattaaaaaagggctgcaaatgcagccctatcttttttgattatttcacttctttaaataaaatctcgcttgggattacggaaccttgccagtaaagttctgtagagactttttctgcaagttgtaagaacgcttgtgaaatttcattttcaggcactcgcacaacggtcgggttgcctgcatctaaatcttcacggatacgaatatgcagaggaagttgagctaatactttcacattgtatttttccgccattttctctgcaccgcctgtgccaaaaatcgcttcgtggtgaccgcacttactacaaatatgcatcgacatattttccacaatgcctaacactggtacggatactcgctcaaacattgaaataccttttactgcgtcaagcagagcaatatcttgtggagttgtcacaaccactgcgccagtcacaggaatttgttgtgataaggtaagttgaatatcgccagtgccaggaggcatatcgataacaagataatctaaactatcccatagggtttcatttaataattggcttaatgcactactcgccattgggccgcgccaaattgttgcactatcttcattcattaaaaagccaatggaatttgcagataaaccatgtgctttaattggggtgatgtgttgattatctggcgaagttggacgttgattcgctgcgcctaacatgtgtggaatagaagggccataaatatccgcatctaaaattccaacacgtgcgccttgtgcttgtaatgctaaagctagattaacagaaaccgatgatttccctacgccgcctttaccagaactcacagcaataatatttttcacaccttttactgccggttgattatttgcacgtttaagtgtggcgatttgataagccaccgcccatttaattgatttacaatctgttgctttcaataacgcatctgaaaccgcttgttttaactgttctgcaccagaattccacgcaaaaggcaatttcaattcaatgcgtaacgtatcgccgcccttttccacttttttcaaagtattaagcacaatcagatccttttgcagagttggatgctgaaattgttgaataatctgctgaacttgattttgctggtcggcagtcaaattatcagaaaagtaggttgccataataacttcctgtttagtagagtaaatttgtcggacatatttaatcacggaaagtgcggtatgttaagttaaagtttttcaaactagaaaaaatcccctatttaaagtaagataagcacaatttttgtatgctaaaaaagagaataataaatgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagcccctgggtgattgcaaaagaagaaggcaaagaggcagaatt

SEQ ID NO: 421 - DNA, 3120 bp, H. influenzae
ccagcaccagggtttggctggatcatgccggtaatgttacgccccgcaggccccagcaataattactttatagccatttttttgtgcattttcagcaaattcaaaaagtttatcaggcgtacgatgagcagagacgatttccacatgataaggtacttctaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatttatgtaagtattaatggggattattttataattatttgatttttaaattttagtaactatacttgataccaaattaatgggcgatagtttatatgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattctatgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaagataacaaaacgtatttacattttctttcatcaaaagtaggtcaaattatgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaattttgaccgcactttcttatgttcttgataattacgagaaagatattgaactggcacattaattctcacactgccgaaagaatggatttgcggaggttcaaaatatcatcctgagggattttaggcgcaagagctttatgccagcccaattgggggatcgttaaagaatgatttttggggggtaatccctattcggttggtgatatataatcacgccaaagaattgcgcttgggggaagtggaatttttgtttattaattgggttttccaatttggggaaact

SEQ ID NO: 422 - DNA, 4004 bp, H. influenzae
ctttgttgggacggatgcgggagaattggcaggaattggtcatcttggcgttgcagtttcagacgatcttgaaagccaaaaagataaattcgatttattaatcgattttacccgaccagaaggctcccttgaacatattgcattttgcgtagcgaataataaaaaaatggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaaggtcactttctacgtgacagcaacataataaaatctcatcaggttgaataaaggcaagaggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtactattatataaggaaaagatgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttggtaacaagaaaaaatggaatagcgaatacgttattccatttttatttttgataagccaatgatttttcgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaagtaatttctcggatttgaattaaaaggataacaacaaaatgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccg

SEQ ID NO: 423 - DNA, 3125 bp, H. influenzae
  misc_feature (2746)..(2746): n = a, c, g, or t
ggaagtaatatttcttgttctaagaaagttttatccatgatgaaataattcatgttttttagatttatttctgaaggttttctttgtttccctgataggtaataataggttgtccacaatactggtaaagaactattattccaaatatcttcatatctttgaattgaagcatcaaaccaaaatctaaaccagcagtgacgtttatttttatatgttcctttttggttaggacagtctgctaatgttaatagaatataaggaatttgatactcttcaagtttattgtattcccaaattttttgttgattagctaatataataaattcaataggttataagttttttgccgaaaaactaatttgacgataatatttttgccaattttttctgaatgaattttttaattcagtccatgcgttttatttggtgataatggaaaatatgattggtataaattgctttagtttaattttatggggcagaattcgctttttgggtaattagaaaaattgctattagaggatggcactgtattaacatttttctcaaataaaacttgagcacaaatagggcagtggcatttgggtgtagtatcttttaaacctaacggtttattaccaaattcaataatgtactccttgacagtgattaaaatttctttgcttggatggttttgctttttccatttttatcctatttgttatacactaaagaataaagcataacaggcttaaattttgatgaattatccacagtacaaataaggcgttattaaaataatttacattctactataggataataattattctgatgattggatgagttttctagataatcattctgataaaacaaaaggattacaggtaaaattacagacttgtgagtattttgggttagtatcaaaaaagtatataggtactggtagagataaatggtaatacacaatatattattttattgtggttttaaaattacgattttggtacttttagtataaagtaagggctatttttattatttacgagcaccaaatatcgcaatcaattctttcacttttacgcgtttttctgggttttggctaatagaacgttggacttttacccgtttaaatttagcaccgttataaatttcacgcgtaaatttagtatcgtgattcgagatcaatatcgaaatttgtttttctttttgtatagatttcgctaaatctgccaaagcacgttgctgcactagtccaaactcattccctgcataaccagtaaaattagtctcttgttgtagcggagcataaggtggatcacaataaatcaccgaatccttatcggcaaattcaaaagttttttgaaaatcacagcataaaaataccgcactttgcgctttatgagcgaaataacgtaattcatcttctggaaaataatgagttttgtaagctccaaaaggcacattaaattcattcttgctgttataacggcataatccgttaaacccaaaacggttcaaatataaaaaaataatcgaacgttcgaaaggatctgttgatgcattgaattggcgacgtttagcatagtaataatcgggtgtattggcatcatcagcgaagaaaatcggcttacaatcttcaatataaccctctacattttctttaacaatattgaatagattgattaaatcagggttgatatctgccaaaatatagcgttcaaaattagaattcagaaatatcgctccagcacccacaaatggctcaattaagcagttttttttgtttggaaaggctttatttatctcgtccgttaaacgaaattttccccccgcccattttaaaaatggacggtgttttaacttaggttttaaagattgttttttcggacgtaacatcttaatccgtttgagtacaacgacgaattgcgtttaacacgagggtatgatcggtatcattcgccacataagcttggcctagagatttgagtaacaccagacgcaatttacccgatagaacttttttatcacgcatcatatgcggtaaatagtcttctggctgcatcgtatccggtgatacggtgggcaaattggcacgagcaagtaatttttcaaggcgagacacatctgcaatagaaatatctccaagttcttccgaaagcaccgctgccatcatcattcccgtcgaaacagcttcaccatgaagccagtttccataacctaagtgagtttcaatggcatgtccaaaagtatgtccaagattaagcaatgcacgatcgcctttttctgtttcatctctcgcaacaacatctgctttaatttggcaacaacgagaaatacaatgttgaagcgcctcaggatgcaaagcgacaagttcatcaatatgttgctctagccattcaaaaaattcgtaatctaaaatggcaccatatttgataacttcggcaagccccgcgtttacttcacgtttaggaagcgtattaagcgtgagcgtatcaataataaccattgatggctgatagaacgcgccaatcatatttttgcctaattcatgattaaccgccgttttaccgcccactgaagaatccacttgtgaaagcaatgtggttggcatttgaattaaacgcacaccgcgctgataacttgccgccacaaagccagcaacatcgccaattacgccgccgcccaatgcaataatcgtggtatctcgcccatgattatcttgcaaaagtgcggtgaaaattaagtttaaagattcaagtgtttntgtatttttcgccatctggcaataaaacatgatcgactacgcaaccacgtttttccaacgcatagatgactgtatcaagataaaactgtgcaacccgtggggattcgttacaatcatcacgcgatccccacgtttaatcggggtaactacgttcatcttgtaacaatccgctaccaattaaataggatagcgacgctcttgcattccacattgacgcacacatatttatcttaagtgggttaaagcgcacatttaatcattcatattatcattaaatcaacatttgattaccatactttggcatttggtcatcagtggcaaaaggaggccgcatttctctaaaacggatgcgaatttgctaatcttcaacctgacagat

SEQ ID NO: 424 - DNA, 3834 bp, H. influenzae
  misc_feature (3744)..(3744): n = a, c, g, or t
acacttcattaaagcattttcttttagtacatttgcataaattaattggtttactggcactgcgataccaagaacgaaagttaccgcaatcccaagaccaaacgcagtggacacctttttagataccgctaagaaagtacacattcctaagaagaaagaaagtgccatattttcaatgaagactgccttaacaaataggctaatataatgttccattgattacttctcctgttgttctggtttccaagttcttaatccccagatcacaaatccgatgataaagaatgcacttggtgcaagtaggaataaaccatttgcttgataccagccaccattttgaatagtttcgaaaatagtcataccaaataatttacctgaaccgataagttcacggaaaaatgctacgataattaacatcgaaccataacctaagccatttccgataccatctacaaaactttcaactggaggggatttcatcgcaaatgcttcagcacgccccattacgatacagttagtaataatcaaaccaacgaatactgaaagttgtttagataaaccataagcataggcttttagaatttgatccactacgataacaagcgaagcgatgattgcgagctgtacaataatacgaatgctgttagggatataattgcggattagggaaacaaataagtttgataatccagttactaaggtaactgcaatcgccataacaaaagcagtttctaattttgttgttacagctaatgcagaacaaatccctaagatttgcaatgcaatagggttgtttttagcaattggcgctaacaacagatctttataacttgtttttccagacattagtttgctcctgaatgaagtttttcaagatatggaccaaagccatctttgctgaaccaataattaaaggtaccttgaacaccattacctgttaaagttgcaccagataaaccatcaatgctatgttcatcttgtggagcttgaccttttacaatacgaatggcaggttgatgttgctcatcaaataattttttacctttaaatagacttgcccagtttggattttcaatttctccgcccaatcccggtgtttctccgtgttgatagtaagtgattccattaatagtattaccatctggttgaacagatactaagccatacatcactgaccacaagccagtgccataaattggtaaaataacttgttgagtttgaccctgttcatcttttacaagataaacttcagttgttttgctacgagaacgaatacgtgctttatccgcatcagcaggaattgcttgttggctatcatctgcttgttgtgtgtattcacccgttgctaaatcaacgaaacgcggctcaataaattttgcataagtttcttttacattcgtatttgcttgtaaaagaccagctacatttaaaatatttttttgtttatcaagcaatttttgttcttcttgtgcaggctttaacattactgcggaaccagcaacaataatggaacaaactaaactcagtagtagcacaacaaggattgtgccgcctacgctgtctttattaaacttagccatttgttcttgctctccgacgtttgatatttgcttgaacaacgatgtagtcgaaaatcggtgcaaataagtttgcaaataaaatcgctaacatcattccttctggataggctgggtttacagtacgaattaatacagccattacgccaattaatgcaccgtaccaccatttaccagtattagtaaaagatgctgaaacaggatcggtcgccataaataccatacccaatgcaaacccacctaaaacaaagtgccaatgccaaggcattgagaacatagggttagtctctgagccaattaggttaaacaaggttgaggttgcaatcatgccaatcatcacaccagcaataatgcgccaagctgcaatgcgagtgaatacaataacagcaccgccaattaaaattgcaagggtagaaacttcccccattgaaccaggtaagttaccaacaaaagcatccatccaagtaattggagcgcctgttacggtatgttgcaatgcaccttgaccaccttgtgaccactgtgaaagtgcggttgcaccagagaaaccatctgcggcagtccaaaccgtatcgcctgaaatttgagctggatatgcgaagaataagaacgcacgaccagcaagtgcagggttcataaagttacgacctacgccaccaaaaatttcttttgcaacaatgataccaaaagtaatacctaatgcggcttgccatagtggcaatgttggtggaacgatcaaggcaaataaaatggttgaaacgaacattccttcatttacttcgtgaccacgaaccacagagaataacaattcccaaatagtacaaacggtaaataccactaagtaaattggtaaaaagaaaattgctccaagagccattttagagccccaagttgcattggcagttaaatctaaacctaatgaacttgcaagagcatagtgccaatcgttagcaattagttgatctaaattgcctaattgatttaacgctggaatcgcttggttacccacattgtacatcccatagaaaatcgcagggaacaacgcaaggaaaaccgtaatcatcatacgttttgaatctaacgcatcacgaacgtgagtgtttttgtgcgttaccgtaccaggtgtataaagcaaggtataaatcgattcaaagatcggataaagcttgctgtatttaccaccgggtaaaaacgcgggttccattttttcaaaaagatttttcaaacccatttttaaccttccttctcaatcttatctaagacttgacgcaagattgaaccgtattcatatttgcctggacaaacgaaagaacataacgccaagtcttcttcgtctaattccagacaacctaactcttgagcgccatcagtatcgcccacgattaaatcacgtaataataatgtaggtaaaatgtccaacgggcattacgcgctcatagctaccgattggcaccattgcacgttcgccaccattttctgaagtagtaaaattaaacaattttttactgaagtggcctaatacggtacgagtcacagaatatttattggcttgtggcataatccaaccaaaaaattctttttcattaccttcagcgattactgatacttgcagagcatagcgacctaaataatcatgtgaatcttttgctatttgaccacaaagaactgagccagaaattacacgatttttacccgcacttaattcattttgggttaattgagaaagattagcaccgattattgtacgtactaaacgaggttctttcacttgaggacctgcaagagaaattactcgttctgaataaagttcgcctgttgtaaataatttacctacagcgatcacatcttgataattgatatgccatacagttttttgaataccgacaggatcaataaagtgaatatgcgtccctacaagaccagctggatgaacaccagtaaaatcatgaatctgtaaattttcaagatcagcagtgggaatattagaatcgcccgctttacataagtgtaatggttttgaagggaatagacgacttaatacggttaaaccgttagtgaagtcttgcgaatattcttttaatacgacagagggatcggctgctaatggattggtatccatcgcgtttacaaaatagaagagcttcactttcatggatggactttactnatggacgagtacgtatgccgtccatagccagatttatcaggtttgtttacttgtcagagaaagtgattcattgttctggcttatttgcaa

SEQ ID NO: 425 - DNA, 3711 bp, H. influenzae
tttttcggcaaataatttttttggatacccccaaaattttttcttgaggaataccgccctttctagcaaattattgttgaaataatcttgtgggataacttgtagaagtaattctcgctgttgtgctgcgattaccgcatcaattttatcttttgttaggaagaaaattcctgtagaaattattgtgcaaagtagggcaataaagcctaacaatatgccataacgcgatgtgatttttactgtacccattattttcttccttttgttggataaccagatacgcgcggacgtgtgtaatgatcgataagtgggacgcaaatattacttaataaaatggcgaatgccacgccgtctggataatttccgtgataacgaatgagataaacaaataaccccactaatgcgccaaaaataatttttccgcgtggtgtaatggaggctgtgacaggatctgttgcaataaaaaatgcaccaaacatcattgcgccactaacgagttggctaatcgcacttaaatgcgtgaaaccagtaaaagcggtcgcagtggctaaacagaaaaaggtgacaagcatcgccactggaatttgccagtgaataatgcgttttaaaataaggaaaattccgcccgctaagaaagccacgttgatttgccaccagccttgagcaaaatcggttccattacccataaaaatcggcagtttaattaattcataaaaatcacttaattgattgtgacttttatagaaaatttttgcgctatccaaaggcgttgcttgggtgatgccatcaatgttatgtgtaagttgtgaaagggtaaatccatccgtggttaaacctgaaaatattaatgaaaaagtatctgaaaaagtcggtggttcctgtaataaattaattggtggcatccaagttgtcatttgtaatgggaatgaaattagaagaattacatagccaatcatcgcgggattgaatgggttttgccctaaccccccataaacctgtttacctaataaaactgcacagagtgttccaatgatgataatccaataaggtgcataaggtggaatagccattgccaaaattaacgcagttagggctacgctgaaatctgaaagataattgagcggttttttacctcgtaattttattgcaataaattcagcaatgattgccgtaccaatggctaatgcggattgaagcaccacgccaaatccaaaataataaatttgcgtgaaaaaagcgggcatcattgccaaaatgacccaaagcataatatgcgctgtgagttttcccgaatgggtatgtggggagctaaccattttaaacattattttattcctgattattttctaatgttgcttgtgtttttgccagtttcttcgcttttgcccgagcaatggcggcggctacggctgcttttttagggtcaagtgcggttgaattttcttgtgttttttctaccgcactatttgtttttctacttcattttctgcggtttgagagtttgaaatagcttcgctggtgctatttgcttgcgcaagtttttttgcttttgcgcgcgcaatggcggcggctacggctgcttttttagggtcaagtgcagttgaattttcttctgttttttctaccgcactctttggtttttctacttcattttctgcggtttgagagtttgaaatggcttcgctggtgctatttgtttgtgcaagtttttttgcctttgctcgagcaatggcggcggctactgctgcttttttcgcatcggttggttgagtttgttggtcttggttttcgcactgagatgctgcttgctgacgagctaaacggcgtgccttacgttgtgccattaaatctgtgttatcaggtaaaacttctcctttttctgaggttagtgttttaatctgcgttggttctgtttcattggcttttttcgctttcaagcgttcgagtgccgccttgactggatcttcccctttagtttgtgctaattcttcacggcgagcctgtgctgcacgttgtgaacgtgctttacgctcttgttcttcacgttccatccgtgcttgttttgcttcaaagcgaattttggcttcatctgatttcttttgtttttcttttatttgccagattttagctttttcttggcggaaatattgaattagaggaatatggcttgggcatacgtatgcgcaaattccacattcaatacaatctttgagagcgtattcttccgattttttgtgatcttcactgcgcgcaaaccaataaagttgttgtggcattaaatttactgggcaggcatcagaacagctagaacaacgaatacaagcctgttctgcttcaggttcggcatattcaagataatctggcgcaagtaaacaattgacaagttttgtcacaggtgcatttaggtttggaagctctagccccatcattggcccacctgcaaatataggaaaatgcttgtcaaattgatagcctgcatcgctcaatatttgggaaatgggtgtgccaagacgcacccaataattgcctttttcagcgattttatttccagtaagggtgacaacacgctcaattaaaggctcgtcatttataattgctctttttattgcgaacattgttcccacattttgcattaatacgccaatgctggatgaacgtgcaccgcttggcacttctatccctgtgagcaaataaatcagttgtttggtagcacctgaaggatattttgttggaataacccgaatgctaatatcatttgctccctgtagtgctgtgcggattgccgatatggcttctggtttgttatcttcaatggcaatgacaactttttcagggtgcaatatataacgtaaaatacgaatgccttttatgatttcatcagcgcgttcacgcataagacgatcatcacaagtgatataaggctcacattctgcaccattgataattaagagtttgactttttgctctgctgactgaattttggcagcagttgggaatactgcaccgcctaaacctgctatacctgcttgatagattttgtgaataagttgttctggcgatagcgttgaaaaatcatcaataggattacgttcgatccattgatctaaaccatccgcctgtaaatgaattgtgggttcatcaagacctgaaggatgcgtggcaacataaggtttaatcgatttaattgtgccagaagtgggcgcgtgaactggcaacatacgcaagccatcgccttttgttaaggcttgtccttttaagacataatcgccctcttttattaaaagattgcctgttgttcctaggtgctgtttgagtggaatgtaaaaatccgtgccgagaggcagatggcgtaatggctgtgaattagattgagatttcatttctggcgcatgaatgccacctttgaaatccccataatttaccggaattgaaacgagataatacgtccgccatttattcccccacaaccaattttttttcagagccatcgacattcattactggaataacgagttttgcatcaaattttcaatcccaattatcaatattttttttcacgggaatcattaaaatacaatctgtcgggcagggccgcacacaaagctcgccacctgttacaagatcggggaatgacgcgtgcattgctttatttggaccaataatggcatcacgggaacagccttggttaccttttgggcagcccatcccata

SEQ ID NO: 426 - DNA, 4326 bp, H. influenzae
  misc_feature (4163)..(4163): n = a, c, g, or t
aaagcattgcataaaacccattcttaatctcacaaagtgttttatttatcagccctgtgccgtaaaactccgtccttcagggcggagatataaggcacagggctgataaatttctaaccgcactttttcaaaaattaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcgcccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggcaaaccaactttaaaatttgggttggttaaactgctaataatcatagaattttccttatagtggataaaagttacactatgataccaagtcggttaaatgaaataaagccaccgattacatcatctctcttgattaatccaattagctcttgtagtaccgagtgaaagagagcaaatatttgccaacttattgacgcataaagtctaaacaatgaaattacggcattaacacaagcattttcagaaaaaatattatcaagaggcttatgaggacctgtaaaatgaaaaataacaagagaaatatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtgatttctacataaggaagataattagcatcactagccatcattacattatatttcatataaaagaacctaatttcagagagaacaatcaatttttaggaggaaaatactgtcgaaacaatgataagaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcataacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttggtgaacgagncaaagggctatcagaggactttctggggtacacacattcgttcaatattacttaggacacatctttgtaagagaattacacaacgtgccaggggaattgccggaaatcccaacattttgctggaaatctcacagaaacctatttttatttagcaaaacacaat

SEQ ID NO: 427 - DNA, 4574 bp, H. influenzae
  misc_feature (4057)..(4057): n = a, c, g, or t
  misc_feature (4130)..(4130): n = a, c, g, or t
  misc_feature (4311)..(4311): n = a, c, g, or t
  misc_feature (4325)..(4325): n = a, c, g, or t
  misc_feature (4545)..(4545): n = a, c, g, or t
  misc_feature (4556)..(4556): n = a, c, g, or t
aagtgtactagaaagcgttaaaaacgcagttaataacagggcaagtggagtactccactgactatctgtatctaagcgatgtatttcacgattaattttgtttaattgttgtttaatacgatttttaaatttaaaaattgcaccacctacaataaataaccctaagaaatacataagtaaataaggtaaattgtcataattagttggaaaacctaattttttcaacataccattaaactgttcaattaaagctcttggcagcatttttatccaatctaaattaatgggattattacttttcacccaaaaactttgctgctctaatttagattgaatttgatcactgatttgtgtaatttgctgctgcgttaattccaaagaaatcgcgagatttaattgattatttaaagatttaatcagatcagatgtcatttttcgacgctcagttaatagcgttttaacctgcgttctttctgcctcagtaaattgttttccatcttcactttcaactttattaatatagttatttagatcataaagttcattgcgtttttgagtaatgtcaaaaatatgcacacgcaaatcggcaatttgttttgataaaccttgaatatttaagttagtcggtaatttttgtttttgttgctggataatacgtgaaagaactaacgtgccttgtaatgcactaatttgttcatcaatagtatgttgagtttgagtgaggctatctaaaatattccgcattcttaactcatcttgagttaatgaattcgctttttctgtttgttgtaatagatactgaccaagctgtgcattgcgatcaagttctttttgaatgtaatcattttgcacagttttttgctgttgctgctgagcttgttctagttgattttgtgattgctgaagatttttttgattaatgacttcttgaatcgcaataatattttgttgttgcacctgcaaacgtaaattcaataggtcgtaacgactttgataaagtaaagaaagctgatcattattttttaataaattttgattataactattctttaaatcaatcagttgtaattcaatctgatattgttttcgtaatgcgctaccaatatcattattggccaattgttgattaatttgctgagtgcgtacaacattttccgttaatgccgcttgagctcgttcagaaatagaattttgccctgccaattgtgcatttgccgcgcctaatgcgttttgcgtatcttgtaattgatcatttatcttatcgagactattttgtaaatcgtcctgtgactgtgcattataatcagtacttgttgctgtttcttgttgtttttttaatgcttgaatttctgcattattctttctaatttcactctctgaatggcttaatgttgttagcaatgcatcattgatctttttgtgagcttgaatttgctgcaataaaacaattgatgtttgtaattctgctaacaacgtatttttttgcttccccctcactcattttttgagcgttagccaaatcggctttaagcgattgctccgttggtaatacatttgttgaatttgcccctaatgccccttgtgaaacactaagggtaaacattgccgaggcaaaaagtacggtaaaaaatggaggtgttttcataagtttcctaatcattattttttcctaatctaaatggtaaaattaatttatcttatcttgctttgccagccaatcggcaagctgtttacgtgagatcttaatgcctttcccaagcatcagtggtaaaggataatatgcaataggttgtttaaaacgtgcgagtttatcttgtaaaaaaaacattaaattttcaaccgcacttttgctaaaggattcattaaaatccactaaagcgacaggacgctgaccaaattctttgtttttttgtggtaaaacaaacacttgattaactgaagaatgttgaataatcacttgttcaatttcttctggctgaatattttcgccaccagaaataaacatattatcaagtcgtccgataataacaagttcgccctcttgccaaacacctttatcttttgtcggaagccaaccttggttattcgttaatgaaacaatttgtcgatccttccaataacccatcgccaaacccgcacctttcagccaaacttcatcatttactaagcgatattctctgcctaagagcggttgccccacaccttgtttttcatcagattttttggcaaaaactgtcgaagccatttccgtcattccgtagccagaataagtttcaataccatatttcactatttttttcgtgagttcagcaggaatatgcgtaccaccaagtaaaatatgacgtgtagaaaatgaaataatcgaattttcctgtaaataatctaacaaacgttgtaattgcgttggcacaagagaaacgtgggtcgtttctaataatgaagcataaaaatcatcttttgggaaatgtaattgtgcaccacaatataaccaacgccaaacaataccttgtcctgaaacgtgatataagggtaatgaaagtaaccaagattgattacaatcaaacttcattaagttacataccccttttgcattatccaaatgcgcttggacattatgcacaactgcttttggtaagcctgtagaaccagaggttagcgtcatcgtcgcaggacgaaaaaaattagctttttgtgtaaaagcatcaatttcttgcaaattcagcaaatctttatcataaaaacaaaaatcaatttgataaaactcacataattctgcaattttttcttgtggaaaagcaggattgatgcctaaaacttttgcgccaagctgaattgtcgccagatataaaaataaaattttctctgaattttttcccacaaaagcaaccgcactttccgcatttacgccttttttttgtaaaaaagccaccgtttggttaatctttgtagttaattctatccaagtaagcgcatcgctctgcgtagtacgtaaagcgattttatctgagaaatcaggttgaatagcaaaattttgccaaggatacattattaatttaccgtgaaatatgatcgcacttcatcaatcaatgtttcaggtaattccatagattgcattgcaccttctagcatcaacatttttcgtccactatttgtattggtaataacccaataaggcgtatctggaatttgttttggttttgtatgattgccagccattaataatgtcgcttcgtcacgtgcaaagtaaactcgagtacgtccttgtaaagattccgttgcttgcgcaaaactttcaggatttgtacgataaagcacacgtaaaatcgctaagaaacgcaccaccgccttactttcttcttgaaattcagttgaatttaataaagtttggactttttctactatctgattaattgcggttattgattgcttttttgttgttttgatatttacttctttcacattaatagcctgttctggcttttgatctgcggatttgttagtttctgctgaagtaagaactaaatcatcaacacttgaagtatgcacaggtaaactaagcaaacggcgtaaaatatccgaagcactttccccaatagagcgggtttggctcgcaatatattggtataattcttcatctacttcaatgatcttcatttttatctctctgtttgctaaaatttttttcaattataacgacttctttacaaattctcacgtaaaaattatggcaaaatcattactcaattatcaatttcatcaagtaaaacaaacgattaatacacctgttttaatttttattcacggtttattcggcgatatggataatctcggcgttatcgcgagagcttttagtgaacattacagtattttacgtattgatttacgcaatcacggcccatagttttcattcggaaaaaatgaattatcaactgatggctgaagatgttatcgcagtaatccgccacttaaatttatccaaagtgatattaattggtcattctatgggggaaaaaaccgcccatgaaaatcaccgcactttgcccagaattagtcgaanaattaatcgtaattgatatgtcccctatgctttatgagggatttggtcataaagatgtttttaatggcctatntgcggtaaaaaatgcaaagcctgaaaatcgtcagcaagccaaaccgattttaaaacaagaaattaatgatgaagacgttgtacaatttatgttgaaatcttttgatgttaattcagctgattgttttcgttttaatcttaccgcactttttaacaattatgccaatattatggattggganaaagtacgtgtatntacgccaactctttttattaagggtggaaattcctcttatataaaaatagaaaatagcgaaaaaattctagaacaatttcctaatgcaactgcctttacgattaatggcagtggacactgggttcacgccgaaaaacctgattttgttattcgtgcaattaaacgatttctaaataagaattaagtagtttaagtgagaatgctttatgaggggatctcntagagtcgacncgcaggcagcaagctgcc

SEQ ID NO: 428 - DNA, 5452 bp, H. influenzae
  misc_feature (4858)..(4858): n = a, c, g, or t
  misc_feature (4868)..(4868): n = a, c, g, or t
  misc_feature (4870)..(4871): n = a, c, g, or t
  misc_feature (4892)..(4893): n = a, c, g, or t
  misc_feature (4917)..(4917): n = a, c, g, or t
  misc_feature (4944)..(4944): n = a, c, g, or t
  misc_feature (4946)..(4946): n = a, c, g, or t
  misc_feature (5158)..(5166): n = a, c, g, or t
  misc_feature (5174)..(5179): n = a, c, g, or t
  misc_feature (5201)..(5207): n = a, c, g, or t
  misc_feature (5231)..(5231): n = a, c, g, or t
  misc_feature (5247)..(5248): n = a, c, g, or t
  misc_feature (5253)..(5253): n = a, c, g, or t
  misc_feature (5263)..(5263): n = a, c, g, or t
  misc_feature (5266)..(5266): n = a, c, g, or t
  misc_feature (5268)..(5268): n = a, c, g, or t
  misc_feature (5271)..(5272): n = a, c, g, or t
  misc_feature (5274)..(5289): n = a, c, g, or t
  misc_feature (5322)..(5322): n = a, c, g, or t
  misc_feature (5338)..(5344): n = a, c, g, or t
  misc_feature (5386)..(5386): n = a, c, g, or t
  misc_feature (5390)..(5393): n = a, c, g, or t
  misc_feature (5407)..(5410): n = a, c, g, or t
  misc_feature (5418)..(5421): n = a, c, g, or t
  misc_feature (5424)..(5430): n = a, c, g, or t
  misc_feature (5432)..(5432): n = a, c, g, or t
  misc_feature (5435)..(5436): n = a, c, g, or t
  misc_feature (5441)..(5442): n = a, c, g, or t
  misc_feature (5444)..(5444): n = a, c, g, or t
  misc_feature (5448)..(5448): n = a, c, g, or t
aaaaacccctcccccttgcatgtgcttacaatggtaaagcaagtaatattagcagcccataatgtaaaactttggagaaaagtcctgcaacacgggcgtgacttggttcaaaacaataaagcagaaagtctttacgtttgaaaacaatcaaacaaaaaatatcgcagaaatgaccgcactttgaatcagctcttgatgacttacacccaacacattaccaaacaaaatatgggttaaatgctgttctgtttgaattttggtaaacataaccaaaccaatagcaaacattccagaaaatacaatacccattgctgtatcttcttttatacggctattttctttcaaatatcccacaccaagcgaacaaaaaatacctgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgctcctaaaataatggcgatgattgacaaggttttgaatttatccgtcagtaaatatgctgttgcaccaggggtaataaccatcgcaatcactaaaatcgcccccacagtttgtaatgcagcgaccacacaagcacttaataaagtaaaaaataaaactttataaaataatggcgaaagccctaccgttcttgcttgtgtttcatcgaaaaaaatcagtagtaaatctttccaaaataataaaagtaatactaaacaaacaccgataataattgcgacttggtaaatatcgtcatcggcaatgcctaaaatattacctaaaatgatattttgcacatttactgcggttggatttaaagaaacgattaacaaacctaatgcaaagaaagtactgaaaataaaacctatcacagcatcttctttcagtttagaaatggatttaatccaaagaatggaaagtgcggctaaaattccggcaaaaaatgcaccaagtgcgtaaggcaacgcaaaagcataggcaattgcaacaccgggcacgacagaatgggaaagcgcatcgccaattagagaccagcctttaagcattaaatatgaagacaaaaaagcacaaatgccacccactgcggtactcaaaatcatcgccttgagcatataatcataggaaaaaggttcgagcaataaatctaacattacctaatccctcttatttttaaccgcacttttataaggacaatcttcaaaatgacaattttgtgttgttggcgcaggtggatcttgcttagtttcgccatagaatacaacggctttttcatcatctgttaagacagtaacagaacgtttatcttcatcattatgtaaattttcgcccaataatttaatatgacgtaataccccaccaaatacaatttccaaattatgttggttaaaggtgttttctgtttttcctgcggcgataactgtgcgattaatcattaccacttgatcacaaaaatcaggaacagaacctaagttatgggttgaaacaagaataagatgaccttcttctcgaagctgttgaagaagatcaacaatggcattttcagttttcacatcaacgccagtaaaagggtcatctaataaaataatgggactttgttgtgctaaagcgcgggctaaaaacacgcgttttttctgcccgccagataactcgccaatttgacgatgcgcaagatgttcaatatttactcgctgcatcgcctcttgaactttttgtttatcaatcgctttggggatacgaagaaaattcatatacccatagcgtcccatcatcacgacatcatacactgatactggaaattgccagtccacttcttctgattgtggtacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatggttgatacagtgacgttaagcaaatcaatataagttggcacagggccgtttttcgcagaaagtgaatcaacgtacaatacgccaccgtattttgcaccactttctttagctacttgttgtgcaggtttcgctgaaattgtactttcactaaacacaactggaatattgtttttacgaactaaatcaatcactttacgcacttgttgtggtgtgccttgttgttctgcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttccaaatttaagccgttccataaaattaaatcggcagattgtgcttttacaatgtcttttggcgttggttcatattcgtgaatttcagcacctggtttggtaatagattccactgttgctgcattgcctgccacattttgcgcaatatcttgaatcacggtaaaagtggttacgactttaaattttgcgttagcttgcattgcaaataaaccaagtgcaagtgcggtcataattttgaatgaatttcgcataagatgtccttatttaaaaaagatagattgaatgcctgaataatcgttcaacagcacaacaattattcatcggaaataatagtactactttttatgttgttttggaatggaaatgattatcaaaataataggtttatttataattatttcgtacaaaatgtattgcttttatgaaaaaagcataaaacaaagaattttcttaatcatacaagcaataaaggtattttctgtcattagaatgactttttatcaaattaagtctagaatattgaaattattatagatttaccatttgaggataagatatgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaatagcgtaagatttattcttctaatttctatttaaatcaactaaaaaacgcgagataaaacaactcttatctcgcgttttttgtgtttatgaacattatcttgataatttctgaattagcgtattaaatcccacttcatcatagccatcttcatattgagcttctccagctacatcacgaattgttcttccatttaatgctgtgcagccgaatttttctaatttgcttttagtaaaactagaacgatacgcagaggaagtgttatttaaactaattacgccaatagttgcatttttgcataggtgtttattaatgaaaacgagattataaccagattctcgaatgtagcccgttttattcactgccgcatcaaagatttcatcacgcactaacttattagtatttttaatataaagtttatgtttcccagcttgaatataagttgcactaagattagataaaagtttaatgtccgatttatttaatgaatatttagcgagtttaaccaaatccatcgggctggaaatattgtagctagataaccctgaactatcgtgaaaacgagtagaatacataccaagttgatgggctttttcgttcattttattaataaattggcgacgacttattcccgctgcacgagaaagcgcgtgggcagcatagttatcagaatggacaagcattgctttcaataattcgttacaagagataggaatatttttaggtaattttgttcctgtacctttaattcgatccgtatcctcttttgtgattgcgattcgacaattaggatttttattattctctaaaaatacattagccgtcattaattttgttacagaggcaataggctgnatatactatncnnaggcgcattagctttccaatnnactcgattatggggtaaaatccanaccaccaaccataagactgtgccgcananagaaggacacaagataaattaaaaaggctttttaaacatttttgggacccctttaaaaagggggggcccccttttttcccccgcgctttttttttcgcgcgccgggggggggggaaaaaattttttgtgcctttaatcccccaaaaggggggggggagaaaatccccccgggggtttaaacccccccccattaaattagggggggggaaaannnnnnnnnaaaaaaannnnnnaagatagttggcggtagagggnnnnnnncgggggggggggtgggggaaaaanaccccccccacccccnnggggnaaggagaganaananaannannnnnnnnnnnnnnnntgtgttttttgggggggagaagccccccccccnaaaatggagggttttnnnnnnnggggggcccccccccccccctggtggggttgttttttttttncggnnnngggggggggggggnnnnaaccaagnnnnatnnnnnnngnggnntgttnntncttntggg

SEQ ID NO: 429 - DNA, 3166 bp, H. influenzae
tgatgcagtaattgacagcagcccaatgaataaccaaatttccagacttaatcttgataaacctattgagccttttgaattaggtatttgcacccaaaaaagaaatctcgaacagcccctagtccgtgcattttgggcgatgttagaatagaataaataatggtttaaaataaggatttcttatgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagtttataaatgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttactaacccattcatcaaaaatataagatataaaaaagtgcggtaaaaatttaccgcacttttgttgttattctaattaactgaaaattagtttttcgctgcagctgctgctttaacaattactgcaaatgcaggggcttttaatgatgcgccacccactaatgcaccatcgatgtctggctgagtaaataattcagcggcatttgcatcatttacagaaccgccgtattgaataattacttgctctgccacggcttgtgatttcgctgcgatgtgaccacggataaatgcatgaacggcttgtgcttgtgctggagttgcagatttacccgtgccaattgcccagattggttcgtatgcgatcactgcaccgttgaatgcttctacgcctaatgcattgatgactgcatcaatttgacgcgcacatacttcttctgttttgcctgcttcgttttctgcttcagattcaccaatacataatactggcactaaaccagcttcttttaatgcaccaaattttttcgccacaaattcgtcgctttctttatgataagtgcggcgttcagagtggccaataatgatatattttgcaccgaaatcttttaacatttcgctagaaatatcaccagtaaatgcacctttcacattgatatctacgttttgtgcacctaattgaatcacacttttaccgccacagctgcaaccacaaccagaaagtgctgcttcagccgtacctaaatacataacggggggggcaattgctacatcacaacctgttacatcatgtaattccgcttttaatccctcgattaattctttcgtgaatgctttgctaccgtttaatttccagttacccataactaaaggacgacgtgccatttttgtttctccatagttgataaaattaacttgcttactataccaaaatttcgcccctattctttgcagaagatcataaaattaaaaaaattctcacagaaagatgattatcttgagctaaaaagctacaattacctgtatggaaccaataaaaaataaccaattatgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgctaacagcgttaaatcgttattgggattatttgcggattgaacgccaaatgagtcctcacacaatcactaattatcaacatcagcttgatgccaccatcaaaatcttatcgcaccaagatattcattcttggacacaagtgacgcctagcgtggtgcgctttattttaccggaaagcaaaaacaagcttaaaagacaaaacttggtttgtgttaatccgcatacgtcaattttcagtttttatggcaccaggcgaattaataggaattctgcccaggcatttctgcccctaaacaggttgttttttacctac

SEQ ID NO: 430 - DNA, 3674 bp, H. influenzae
tgatgggctttctttgatagcttggcgattacttggtgtttatatcgccactatcgttgggcttgtgcttaaaccttatggcgagcccgttatcttattggctgcaattgcggtttctggcgttatcatcggtaatactgaaggggcgaaagaattggttaaagtcggcaatatgttggatggttataaatctggcacaacatggcttatttttaccgcattcactttgagttcagcatttgtaatcacaggtctaggtaaacgtatcgcctatcatatgatcggcgcaatgggtagcacaaccctacgcttaggttatgttaccatgttcttagaccttttactctcgccagcaacgccctctaacaccgcgcgttcaggtgggattatctttccaatcattaatagcgtagtggttgctcttggttcagatccagaaaaaagcccgaaaaaagcagggcgttatttgatgatgaacgtatatatggtggttaaaactacctcttatattttcttaaccgcaatggctcctaatgccttagctctttcattaatggcaccaattcttggttttgaaaccacttggatcaaatggttcttagctgcatccgtacccggcttactctgcttattcttaattccgttaatttgttattgggtatctccaccagaattgaaaaaagtggataataaagccattgcgaaaaaaggcttagaagaattaggtccaatgtcttttcgtgaaaaagcactcagcgtgttattcgtaattgcattattcggctggattttctctaattcacttcatatcaatgctaccattgttgcaatcattgtaatggtgctttgtattgtattaagtatcgtcacctgggacgatatcttaaaaagcaaaggcgcatggaataccctagtatggtatggtggtatcatcggcatgtctggcttgcttgaaaaatctggctttttcaaatggttagcaaacaccttaagtaccatacttcagtttgagggacatggtatgatggcgttaatagtgattcttaccttaagtgtctctgtacgttatttatttgcatcaggcggtgcatatgtagctgcaatggtacccgtatttgcaacagtcggacatgtaacaggtgctcctactgaattgcttgctctaggcttagtctttgctaattcttatggtggttcagtaactcactacggaggcggaccaggtccaattgcattcggtgcaggttataatgatataaaatcttggtggattactggtgcgatcattgcttttggtagtttaattatccatctaactatcggtatggcatggtggaaattattaatgagtttaggctggttataggctgatctttttttaatttaactgctattttgacggtgtagtagacaaagtagttgattataaatatatgcttgcgctttcctaaaaagtgagctctatttaatccttttggtttaccttgaatatacacatcgttgtaatcgcgataagctagtatttcctttaattttatgaactaatatttacctcatactgcattatatcttgagtatatttatgaatatcttattttttaatgatttacaagcctttctagcttatcaaaatatcctgtttagtgtctttcaccgaatattcactagccagaattatcgtaagtctgtagaatagccgaccgctttattcgactaattatttataacacctaacgatattgtagaaaatgactcaaaaattacatattaaaacttggggctgtcagatgaatgaatatgattcatctaaaatggccgatcttttattaagcactcacggattagaactcacggaagcacctgaagaagcagacgtattattattgaatacctgttctattcgtgaaaaagcacaagaaaaagtgtttcatcaacttgggcgttggaaagaattaaagaaaaataatccaaatttagtgattggcgtgggcggctgtgtggcttctcaagaaggggagcatattcgtcatcgcgcgccttatgtggatattatttttggcccacaaactttgcatcgtctgcctgaaatgattaatcaaattcgtggtggtaaaagttctgtggttgatgtgagtttccctgaaattgagaaatttgaccgcttacctgaacctcgcgcagaaggcccaactgcatttgtttccattatggaaggctgtaataaatactgtactttctgtgttgtgccttatactcgtggggaagaagttagtcgtcctgtagatgatgtgttatttgaaattgcgcaacttgcggaacaaggtgtgcgagaggttaatttgcttggtcaaaacgtgaatgcctatcgtgggccaacgcacgatggtcaaatttgtagctttgctgaactgcttcgtcttgtcgcatcaattgatggtattgaccgtttacgtttcacaaccagtcatccaatagaatttacaaatgatatcattgatgtgtatcgtgacacgcctgaattagtgagtttcttgcatcttccagtgcaagcaggatctgaccgtgtattaacgatgatgaaacgtggtcataccgcattagaatataaatctattattcgtaaacttcgtgcagtgcgtccagatattcaaatcagctctgactttattgttggtttcccaggggaaactgcggaagattttgagcagactatgaatttgattgcacaagtgaactttgatatgagcttcagttttgtgtattctgcccgaccaggtacgcctgctgcagatatgccagatgatgtgacggaagatgaaaagaaacagcgtctttatgtgctacaagagcgtattaatcaacaagccgcacaatttagtcgtcgtatgcttggcacagagcagcgcgtgttagttgaagggccatcgaagaaggatattatggaattaacaggacgcactgaaacaaatcgtattgttaatttccaaggttctccagaaatgatcggtaagtttgtggatgtaaaaattactgatgtttatactaattcgttacgtggcgaagtggtgcgtactgaagatgaaatgggattacgtattgcacaatcgccacaagaagtgatgaatcgcacacgtaaagaagatgaattaggcgtagggcgttatcacggctaattaaaatgctgaaatattcaaccgcactttgagagattaaagtgcggttattttttagagatatatggtttagatttgccaatcaattggtttcattccattactttccaaatatgaatttgttttggaaaaatgatgacagccaaaaaaacctcgatgggctgaaagtggggaagggtgcggagccgttaaaacaaggtgacgagtgcggtcaataatttgtccttttttttgtgcgtgactgccccaaagtaaaaacaccagtttttcacgatgttcattaagcactgcaataactttatctgtaaacctttcccaacctaaattggcgtgtgaatgtgccatacctcgttccacggtaagcactgtgttaagtagcaataccccttgctctgcccatttgactaaataaccatttgatggcatttgaaatcccgaaatattttgtgtgagttctttatacatattaattgggagggtaccgagtccgaatcgtaaaca

SEQ ID NO: 431 - DNA, 3694 bp, H. influenzae
tgttatacgattcggactcggtacccgttactaagtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtgggtaaattccccacggcgcaatgattgttttctttattaaacaaaaaccatccataacggcaagcaaacagcaataaataataggataaataaactattggtagataatatccacttttggaaactatgcagaatcagaatagccgcaatcacaaaatggcaaacaaaataaatgatgtaggcaaaaacactgtcagaattaaccgcactttccataccatttaaaagtaaaaataaaaacattgccaaagcatttagagcaagcaatataatcattgctaagggcaacaatgctataaaaccttgtaaacgatttcgtgcaataacaagcgcaagatttgctaaaatcacgccagataaaattggtgcaaaagggttatattcagcaaaatcactcgcaggaagcacggtaaaaatcattaaataactcaagcaacctaaacccgcaattaatgcagccatcaataaaaagctgttacgaattttttcagttttgggttgtttccaaataaaatacacgacagaaagaccacatacgctcattacgttagtaagcgtgtgattattttgtaataggcttatcagcaaccacactgcccaataaatagcaaaagtcatattcactttgattaaacgaccacgttgtcctgggcaaatttcgccgcgataaaacaccaacaacgaaattaactgtgcaaccaacacgcctacacctaaatgaggcattgtttgcttttcagattgcaaagaaaaaataaatagatcgatgccaagcaccattgagatcgataataccgcaagcaatgctgcgatatatttagaagattgttctgacataattttgacgtctgaaaaaataatgcgtcattatgctaaaaattcattaaattttaaagtaaaatgaaaccaattttaaccgcacttaggtacatgaatgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgcccggtgtttaattaccaagacctcacatcggaagaacaagataagctgccaaataaaaaggaataaattccataaagggaataactatgttagaacaaatgggtaaacaagccaaagatgctgcattatcttggctcacttcaccactgctgaaaaaaattgtgcattatccattattgcagaaccacttccaacaacaagcaccgcttatcttagccgaaaacgcaaaaagatattgaacttgctaaacaaaatggattatcggatgccttgattgatcgcttactgctcacacaagaacgtttacaaagcattgctaatgatgtacgccacgttatttctctagcagatccccgtggggaaaatcatagacggcggtacattggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaataaaacccaaagtgcggtaatttttagaagagattatttgcatataaaaaagtccgcgaaatgcggactttttcattatctttatttgtcagatttacccaagttatcaaagaattttttcacaccgtctaaaaatcctgaagattttggtgcgtgtttacttaaatctttaccttgtaaactttcctcaagtttgtggagtaattctttttgttcgctggttaaattaacgggcgtttctaccacgatacggcaaattaaatcgcccgcataaccactacgtgtagaagcaacaccttttcctcgcatgcggaataattttcctgtttgcgtttcagcagggattttaagtttcactctgccatctaaggtcggcacttcaatttcaccgccaagggctgcagtagcaaagctaatcg

SEQ ID NO: 432 - DNA, 3999 bp, H. influenzae
  misc_feature (616)..(616): n = a, c, g, or t
  misc_feature (3989)..(3989): n = a, c, g, or t
tgtatacgatatcgactcggtaccctttttcgtttaaagtgcggttaaaatttcaatctttttaggaagaacgtatggacattcgtaaaatcaaaaaataatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataatttccaatattttcgtcggggcggactttagtccgcctgtttcatatacaaataattagagcgaatttatcgtangcgatataaattgaaatctgttcacaccaaattttataggggagaacaatatttcaataacctacataaaaaatcacgtctatctgactaaacggactcttttatgttagaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctctcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataattaaacgttaaatggctaacaatggttagccatttcttatatatgccgatatttatttaatgataataaaaactaaagctagtaaagcgttttgaattattcaaaaaagttgtaatatgaataagtataaggggcgtaggatatatgtgcctcttataccattcaaaaaatatactttcacttataaaaatttaaggaagaaacatgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattgggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgctttttagtaggtaataaattgggcgaacgtcgaatcgaaaaaactcaattaaaagctaccggggtaccgagtccgatatncgtataacat

SEQ ID NO: 433 - DNA, 4461 bp, H. influenzae
  misc_feature (1537)..(1537): n = a, c, g, or t
  misc_feature (4385)..(4385): n = a, c, g, or t
tgttccgattcaactcggtatccctttatgcgtcaaagcaggcggtggcggcaaagcgatgttctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagccntgaaagtgcggtagaaaataccgacaattttaatgtttaacttatcaaagcctttcttcggaaaggctttattttttcctaatgatttttttcttggatgtatttcgctataatcgcccaccaaaatcactctaaaaattaaccgcactttatgaaactttacgcaaataataaatgtcttgatttaagcgttcctaagattatggggaatccttaattttacgccctgatctttttctgatagcggacagttttttagtttggataaagcgctttttccagttgaaaaaatgttggaagaaggggcgacaattattgatatggtggtgaatctacgcgtcctaatgatgcggatgaagtctctgaacaagaagaattgcatcgtgttgtgccagtagtgaaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcctgatggttttataaaaaaattaaaggaattgtattatggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcaaaatgaacatttttattatgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtttgcaaaacgaaatccatatcattttatcctgcactattgctcattattatgggatgtnataaatcagaatattgatgcatcaagctctcctgtatttatttaaaataactattcttttttacaaaataaattta

SEQ ID NO: 434 - DNA, 4175 bp, H. influenzae
tggggattcatcaccgccgagtttttaatgggctcaagggttaatgaacatgtaccgcattttggtcacctcgaagtctgcgtaacacgccgcacaaccgaagtggtgtaattgaatcgctttaccttcgattaagatcggttcaaaacgcttggatacccaaacggtgaagtgttggcgcacggttcaatagaattgggtgttcacgaataacttctgcaagaatatcccaaacgatcgcctcttcacgctcaaccattttcttagccgctttgattgtcgtagcataaccacggctttctaatttcgcatagataaacggacggaataattccaatgccattttcttcggtaaaccacattggtgtaagtgcaagtatgggccaacagtgattacagaacgaccagagtaatcaacacgtttacctaataaattttgacggaaacgaccttgtttacctttgatcatatccgctaatgattttaatggacgacggttagaacccgtaattgcacgaccgcgacgaccattatctaataaggcatcaacagattcttgtaacatacgtttttcgttgcgcacaataatatctggcgcaattaaatctaataaacgttttaaacgattgttacggttgattacacgacgatataaatcgttcagatctgaagtcgcaaaacgaccgccatcaagtggtactaatgggcgtaaatctggtggaagaactggcaataccgtcatcaccatccattctggtttattaccagattgaacaaatgcttctaataattttaagcgtttagtgatttttttacgtttagtttcagagttagtttcttgtaattcttcacgtaatttttcacattcagcttcaagatccataccttttaagagatcttgaatcgcttcggcacccattttcgcttcaaattcatcttgccagcgatcttcagcgtcaaggtattgttcttctgttaataattgaccgcgctctaagtccgtcatacctggttcggtcacgatgtacatttcaaaataaagtacacgttcgatatcgcgcaatggcatatctaaaagtaaaccgatacgagacggcaatgattttaagaaccaaatatgtgcaactggcgatgcaagttcaatatgacccatacgttcacgacgaactttagtttgagtgacttcaacaccacatttttcacaaatcacaccacggtgttttaaacgtttatatttaccacataaacattcgtaatcttttacaggcccgaagatacgcgcacagaaaagaccatcacgttcaggtttgaacgtacggtagttaatggtttcaggtttcttcacttcaccaaatgaccaagaacggatcatatctggggaagctaacccaattttaatcacatcaaaatcttcactggtttttgattgtgcttttaaaaacttaactaagtctttcacaaatgttctcctgtcggagttaaaggtttaaagtgcggttaaaaatttcggagaattttgaccgcacttcggcgatttattgtttcgtcattttttctcttcgctccccctgtttacggggggagctgccgcaggctgaggggaggaatttgttggcagtagaatcattgcaatcgctataaatgtttcacttaatttatgtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaaatcactgtcacaaccaatctagggttttcataaggcgcatatgcggtaaaccatgcgtgatcatgcaattcttttttcaatcccaccgcattgtatttttcattttcttttaaactaaacacttgagcagtaccagattttcctgcaacacgataattggcatctgcaaaggcttttcgcccagttccatttgcagcattaacaacattgtacataccgcgtttcgctgcctcccaagccgtcactttaggtgtactaatatcaggataaattaacggatcttcataaggctctagaactgccccctcaattgctttcatcaaatgcggcgtatttactttgccattattgaccaatatcgtcgttgcttttgctacttgtagtggtgttgccgtccaataaccttgaccaatcccaaccgaaatcgtatcgccttgtacccaagggcgtttatagcgtttttgtttccattctcgagttggcatattggcagccgtttcttcttgaatttcaatccccgttggcataccaaaaccaaaatccttcatccaattagaaagacgatcaatacccatattataagccacttgataaaaataagtatcagaggattcagtaatcgctttattcaaatccgtatctccgtggcctgtttttttccaatcacgaaaacgttttgtggagttaggtaatacccaatatcccggatcaaaaatcgttgtgtttggtgtaatcacattttcagtttgtgcggctactgcaataaaaggtttgactgttgaagcgggcggatacgcaccttgtgtcgcacgactataaagcggacgagcaggatcatttaataaacgtttataatcttcggaggaaataccatcaacaaataaattattgtcataacttggtgtagataccatcgctaatacactactatctttaggatcaagcacaactacagcaccttttagtcccgataaaagttcagtaatataacgctgtaatgctaaatcaatagttaaatgaatactttttcccgccacagcaggtcggctacgcaaagtacggattactttgccgcgattattaatttctacttcttcaaaacccgtggtaccttgcagtatatcctcgtaataacgttcaatacccaattttccaatatcgttcgtccccgcataattcgcaaatttatcctctcgtttcaaacgttctacatctttatcattcattttacctacatagcccaaaatatgcgccattgtttcgccatataaataatggcgtttgaaataaggacgtacctctaaactcgggtattggtagccatttaccgcaaagcgtgaaatttgttcttctgttaaattcggctttaataaaatcggtgtataacgcgttccgcggagacgttcttttttaaaatgttcaatatcgttatccgtcaatcccacaatgtagcgtaattcatctaaagtgcggtctaaattttcagttttttccggcacaatgtataaaccaaaaaaagtaagattttcggctaataatttaccgtaacgatcatagattaagccacgcgttggcggtaaaggtaataatttaattcggttaccattagaacgcgttcggtaagtatcgaaattaacaatctgtagctgataaatattggtgaataaaacacctgttagtagcaaaatccccaaaaaagccactaacgttcggcgtgcaaaaaggctacgctccgcttttttatcgcggaacggctcatgagttggcgtattgaaaaattttttaaattcatctggctaaaaataaggatgtattattctcgatgataaggatgattagtagtgagcgaccactcgcgatacaaactttcagccactacaacacgaacaagtggggggaaggtaatgttcaatggcgaaagcgaccaactttgctctgcagcgggtttacaattcggc

SEQ ID NO: 435 - DNA, 4056 bp, H. influenzae
  misc_feature (4003)..(4003): n = a, c, g, or t
  misc_feature (4010)..(4011): n = a, c, g, or t
  misc_feature (4022)..(4022): n = a, c, g, or t
  misc_feature (4026)..(4026): n = a, c, g, or t
  misc_feature (4029)..(4029): n = a, c, g, or t
ctggtatacgaatatcggactcggtaccctttaggttcgttaatccttttacattttcagctatgaataatttgggttgagttatagatattacttctctcatccacatgtataattgtcctctattttcaattgagggttcatctatatttgatatttttccatgatgatttttgtgagaatcaaatcctaatcgttttccagctacagaaaaatcttgacaaggaaatccacctgttaatatatcaatgtcttttgggaaaatattgtgagtttcccgttctttttttacaagatcaacaatgctttctaagtggtagatttcgtttgcattcgctttttggtctaagaaataagaaacccatgctgctttagcatcaggtttaatatcattagcaaaaattgtctcaaaagaagtgggcgaaacggtaacccattcattttctgtggagctgatccattcagggtggagctcctcattaatagatttttttagacaagagaaactaccttcaaatccgatatccattcccccacaacctgagaatagagatattagtttcatttatcccccgaaattacatatggaaatgcgtttagatattgataaaagtgcatttatatcctaattagagttaatgttagaacaatagttataaagattttttccaatcatatatattcttctaacagtttaaggtcataataatctagtttggaattataagttaaaagtatgatattgtaaaaatactctattgatatacaaagtgcggttaattttgaaaacttttttgaaattgaccgcacttttttaatttaatctcttaagcaaattttctcaaattcactaaagaatgtaggaaaggttttggcagtacatttgggatctaaaatcgtcacaggtgtgtttgatagtgcgattagagaaaaacacattgctatacggtgatcgttataggtctcaatattggcgtgtttaaattgattgagtggaagcggttgaatatgaataaaatcttcaccttcttcgacttctgcaccgactttacggagttcagttgccatagccgttaaacgatctgtttctttcacacgccagttataaatattgcgaatgacggtttcgccgttggaaaaaagtgcggtggtcgcaatcgtcattgcggcatctggaatgtggttcatatccatatcaataccatttaattcagcgtgttcggcttggataaaatcctctccccaagtgatttttgcccccattttctctaatacatcagcaaataaacgatcgccttgaattgagtttttgccaatgcctgttactttcacttttcctttaatggcgccagctgcaagaaagtaagaggctgatgatgcatcgccttctaccaagtatttattaggcgaaatataggattgatttcccttaacttgaaatttttggtagtgatgattttcaaccttaacaccaaaatctcgcatcattgcaagggtaatgtcaatatagggtttagagactagttcaccgataatttctatttctgtgtcattttctgcaagtggcgcagacattaaaagtgcggtcaaaaattgagatgaaattgaaccatcaattttgacttttccaccttttatccctttgttgcgaattgcgagcggaggataaccctcattctctaagtagcgaatatctgcacccgcttggcgtaaagcatcgactaaatggagaattggccgctctttcatacgaggttcacccgttaagatgatttcgctttcggtttttccttttaagcaaagtgctgcggttaatggacgcattgcagtcccagcattgccaagaaagagtgaaagattgtcctgtatattgaatgttccacctaatccttctacttcacaaatagttttatcatcagacagttgatagcgtacgcctaatgctttcagtgcgttaagcatatgtcgaatatcatcgctatctaataaattggttacttttgttgttcctttagctaaggcggctaaaagtaatgcgcgattcgataaacttttagaacctggtaaattaattgttccttcaaccgcacttattggtgcaagagtaattttttccattacaacaccaccgttttatttttataaacaaaaattctatcgtgtaaagcgagatcaagggcgcgacttaacacggttttttccacatcacggccagcacgcatcatcgcttctgcattataagtatgatccacattaatcacattttgcataatgattgggccttgatctaattcgttattaataaaatgtgccgttgcgccaataatttttacaccgcgttcataggcttgttgataaggcttggcaccaataaaagcaggcaagaatgaatgatggatattaatcactcgatttggataacgtgcgacaaattcagggtttagcacacgcatatatttagcgagaacaatataatctggcgtatattcatcaattttttctgccagtaatttgtcgtgttctacacgggttaagttttcgtggctaactaaatgaaatggaatattaaaacgttcaacaagttcacgtaaattatcgtgattgccgattacggctgcaatttctacatcaagcgcaccataataatttttcattaaaatatcgccgaggcagtgagcttctttggtgactaaaattacaattcgcttacgttgggtgccaattaatcgacaattcgtttcttcgggtaagctatattttagatcttctaataaagtagcttcgttaaaaataccttccaattctgtgcgcataaagaaatgtttggtttcaaaatctacaaattcattattatgaagaatatttagttgatgtttgtaacaaatattagttatttttgcgattaagcctttatcatcagggcaatcagtgagtaatatttttttttcgatcataatgttgtgtgctatgtttagataaaaaaatagaacccataaaataggttctagtttcaaatagaaaaattaaatttcgaaatcagataatgatttacctttgttcaacgcattttgaattgggcgtggtgtgcgaccttgacccgtccaagttttatgctcgccattttcatcaataaacgcatattttgcagggcgtggagcacgttttgctcgaattgatacagtttttgtgccaaaaatttcgtgtaattcttcaggtgtaataccttctttttccattaattctttatatttagctaaacgctcttttcgctctgtctctgctttaattaattctgcttcattagcacgtttttcttcgatagctgtttgtaatttttctagggcattttctgcttgttctaacgttaattcacgtacagctgcacgtaaactacgaagatttgttaaacctcttactaattcgttcataataaacctcaataaataacattaaatgtgggaaaatttatttaataatagagaaaataaaatttattgtaaatatctattattaaataaatggtcgaaacagatatatttttttgtgtttattttctttatatttttattaaagtttataaaatttttataaaatctgttggcattttgtttgttttacggtaatctccccaatcactacaaaagtagaggcgcaattattataagtattttttcagagtggataacgaagaagaaaaaagaaaggaatagttgccgaaatcaaataaaagtcgttttgtttggttggtggcgtgctcgaaaggggcgacactgtcatagtttttctgattaactatggagtgctacggttgttctggtcttattctgtcctatgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatccattaatgttnaaggggnnatccccctagnagtncgnacctgccaggccagccaaggtctaggc

SEQ ID NO: 436 - DNA, 3599 bp, H. influenzae
  misc_feature (318)..(318): n = a, c, g, or t
  misc_feature (3557)..(3557): n = a, c, g, or t
tacgatatcggctcggtacccttacttcagcacgctgaattagcagaacgttgtgatttaccattggtcgcaactaatgatgtgatgtttttgaatgcagaggattttgaagcccacgaaattcgcgtagcgattcacgatggctatactttagacgatcctaaacgtccgaaatgttatacctcacagcaatattttcgtagtgaagaagatatgtgtaagctgtttgcagacattccttccgctctcgaaataccttattaattgcgcaacgttgtagtgtgactttgcgccttggtcaatatttcttacctcaanttccaactggcgatttaagtacagaagatttcttagtgcaaaaatccaaagaggcttggaagaacgtttagtttttttattacctgatgaaaagtgcggttagaaaaacgaccaaaatatgatgaacgcttgcaagttgagctagatgtaattaaccaaatggggttcccaggttatttcttgatcgtaatggaatttattcaatggtctaaggataacgatattccagtagggccaggtcgtggttctggtgcgggttcattagtggcttatgcattaaaaatcactgatttagatccgttagagtttgatttgctatttgaacgtttcttaaatccagaacgtgtgtctatgcccgatttcgacgtggatttctgtatggatggtcgcgatcgcgtgattgagcacgttgcagaaacctatggtcgtggcgcggtatcacaaattattacctttggcacaatggcggcgaaagcggttattcgagatgtagggcgagtgctggggcatccttatggtttcgttgatcgtatttctaaattgattccgccagatccaggtatgacgcttgccaaagcgtttgagaccgagccgcaattacagactgcctacgatagcgatgaagaagtgcgagcattgattaacatggcgcgcaagctgaaaggtgtgacacgtaatgcaggtaaacatgcaggtggcgtggtcatttcgccaaccttaattactgatttcgcaccactctattgtgataatgaaggcttacatccggttactcactttgataaaaatgatgtggaatatgcagggcttgtgaaatttgacttcctaggcttgcgtactctcactatcattaaatgggcattggatataattaatgttcgtatggtgcgtgaaggcaagcctcgagtagatattgccgccattccacttgatgatcctgaatcttttgaattacttaaacgttccgaaaccaccgctgtgttccagttggaatcacgaggtatgaaagatttgatcaaacgcctgcaacctgactgttttgaagatattatcgcattggtagcattgttccgtccgggtccgttacaatcgggtatggtagataactttatcgaccgtaaacacgggagagaagaagtatcttaccctgacgcagaatatcaacatgcaagtttgaaacctattcttgagccgacttacggcattattttgtatcaagaacaagtgatgcaaattgcgcaggtgttggctggctatacgctgggtggggctgacttattgcgtcgagcaatgggtaaaaagaaaccagaagaaatggcaaaacagcgtttagtgtttaaagagggggctgagaaaaacggtgttgatggcgagctatctatgaagattttcgacttggtggaaaaatttgctggctatggttttaataaatctcactccgctgcttatgccttggtgtcttaccaaactctttggcttaaaactcatttccctgcagaatttatggctgcagtgatgacatctgaaatggataatacggataaaatcgtaggtttgtacgacgaatgtttgcgtatgggcttaaaagtgacgccaccagatattaatatcggaaaacaccattttagtgtcaatgaacaaggcgaaattgtgtatgggattggcgcgattaaaggcgtgggggaaggcccgattgaagcacttgtggcggcaagaaatgaaggggggattttcaaagatttattcgatttatgcgctcgtgtagatttgaaaaaaattaaccgccgtacttttgaaagcctaattatgtcgggtgcctttgataaattaggcccacatcgcgccgcactttctaagaatttggaagatgcacttagagcttccgatcagcatgcgaaagatgaagcaatgggacaaacggatatgttcggtgtgctgactgaaacccatgaagacgtggaaaatgcctatgctaatacaccaccttacactgaaaaacaaatccttgatggcgaacgagaaaccttggggctttatttaagtagccatcctgttagccgttatttgaaagaactttctcattacacatcaacgcggttgaaagatctcgcaccaaatcgccgtggacaaattagcactgtggcggggctagtcgtggcatcgagaattgcgatgacgaaaaaaggcaatcgtctaggtattgcaacattggacgatcgttcaggtcgcttagatttaacattatttggtgaaagcctagaacaatttggtgagaaattacaaaaagatacagtgattgttgcttcagggcaggtgagctttgatgatttctctggtggcttgaaaatgacggtgcgcgagttaatgaccttagatgaggcacgttctcgttatgtcaaatccttggctattagtctttctgagcatcaaattacaccaagtttcattaaacaatttaaagcattacttgagccagtgagtggtggaacattgcctattaacgtgtattatcaaagtccgaaaggtcgtgcgttgttacgtttaggcgtgcaatggtcgatcattccaacagatgaaattctgacggaattggtgaatttactcggcgaaagtgcggtggaattagagtttgaataagacaaaggcgtgaaaaatatcacgcctttttataagattaacgtaagaaataacgataagatttgctttctgttacatcttcaaaaacataattgagttgggcaagtgcctgttcaaattctgcttgttcgcgttcttcaatttggaacccagcaaggatatttccatagtccgcaccgtgggcacgatagtgaaataatgaaatattccaacgattttgcaaggtttccaagaattttaataaggcacctttttgctctgggaattcgaaggtatataaacgttcgttatcattcgatgctcgaccacccattaaatatcgaacatgcgttttcgcaatatcatcatcagacatatcctcaacatcaaaaccattttttcgtgaggtctgcaataatatccgctttttcttgcttatttggcgttcctaccccacaaacacgcaagcacgtttatcatccgcttaacgataactgaattcggttacagctccgttacctattacataaccaaattttaagaaattacttgttgttcagtccggttacccctcataaacccttctattttaccaattcccacttttaaaaacttaatgtagnggggaaattcagtttttccataaaaacgcttccctattttca

SEQ ID NO: 437 - DNA, 4214 bp, H. influenzae
  misc_feature (2887)..(2887): n = a, c, g, or t
  misc_feature (4183)..(4183): n = a, c, g, or t
  misc_feature (4186)..(4186): n = a, c, g, or t
attaaaaagcggcactaatgaatccaacaaccgccaatttcacgcagcagtaagatgccatgcccaatcaaaaaacctgccaattaacgtaacaaggggggtaagtgggtatgtgatcacttgatcttttttaatcgaaaagtaccatttgtgtggctaaatataccactaagcaaacaaaaattttggcagaaatttcacgatcaagtcttccaataaatgaaccacaaataaagacagaaagcataataaccggagctaaaatgcgaactgcctgccagactatgttacataatttatgatgacgttgtgccgatccaatgccagtaatcacaatggtagcaaatgatgtgccaagtgcggtagacatcaacaaagattctggtacatctacaatgggcagtaaatacactaaggttggcacaattactaaccctccgccgataccaaataatcctgcaagaaaacccgctaatgcaccaacaagtaaacaaagaagaataaaagtgaacattattgaccttttgatttgtaaaaatggcgttttgtgtattttgtctgagaatattttttatttgccgaattagactgtgaatttgcttcacgagatgcggaaaatattggtggattatccgtaaataataccgaagcaaactctttcattacctttcgataaacatctcgcttaaaagacacaacttgacgaacaggataccaaaaacttacccaacgccacccatcaaattctggcgatttggtcgttttcatattgatatttttttcatcgccaacaagctgtagcaaaaaccagcgttgtttctgcccaatacacatcggcttgctatcataacgcaataaacgctttggcaatttataacgcaaccaatgtttagaaacatataacaaacgcacatctttaggttgtaaaccaacttcctcgtgtagttcgcgatacatcgcttgctcggcactttcattatcattaatgccaccttgcggaaactgccacgaattttgcccacaacgcttcgcccaaagcacttgccctttgcgattacaaatcacaatacccacatttggacggtagccatcaaaatcgatcactatcgttttaccttacatttttcctataaaaatagctcaagattgtttcataaatcagtgcttttatcaaccaaagggcattatgacaaaataatcatatcatcacgatgcattgccaccgcaccatattcatagcctaaaacattttcaatatctgctgattttctgcccttaattaattgtagagcatcgctgttatagcgtggcatacctagtacaatgtctttaccagattgagtgcatattttgactacttcaccacgcgaaaaacgcccttccacgttaataataccagcgggtaataaagatttattttgttcaagaatggcatttttcgctccatcatcaatagtgataatgcctgccgatggcgcggcgaaaagccattgtttgcgactttctaatcgatcagattggtgtgcaataaattttgtaccaatattttgttcataagcaagatctgcaattacatttggacgattacctggtgcaataattgtttcaattccagagcgagtggcaacatcggcagcaatgattttagtcatcattccacctgtgccaagatttgtaccacttcctcctgcaattgatcgaatgtgatcagtgatttgttctacaactggaattaattttgcttcaggatttttacgcggatcactatcaaataaaccttgttgatcagtcaataaataaagttgttccgcttgcacaagaatagcgactagtgcagataaattgtcattgtctcctacttttatttccgcagtcgccaccgcatcattttcattaatcacaggaataatgtggttatctaaaagtgcatgtaaagtatctcgtgcatttaaaaaacgttcgcgatcttcaatatcagcacgagttaataaaagttgcccgatatgaatatcataaatagcaaataatttttcccaagcctgaattaattggctctgaccaaccgctgcaagcagttgctttgaggcaatagtgggtggtaattgaggatgatttaaataatggcgacccgctgcaatagcaccagaagtcacgattactatacgaaatccatcattatgcagttgtgcaatttgacgaacgatttccatcatatgtggcgaattcaattttggcgaaccctgagttagcgtgctagtaccgaatttcacaacgattgtttttttgttcatagtcctttccaacgttcttaaaattgacattaacgttatcactaaatcaatgaaaaatcacttaatatcaggtatagtaacggcaaattttagggggatctatgacatttagtttaattgtggcgataacattaaataatgtgattggtaaagataatcaaatgccttggcacttgcctgcagatttagcttggtttcgtcagaaaaccactggtaaacctgtcattatggggcgtaaaacctttgaaagtattggtcgtccactacctaaacgtaccaatatcgtactttctcgccagctttttgaacacgaaggtgtgatatggaaagatagctttgaaagtgcggtcaattttgtcagagattttgatgaaattatgttgattggtgggggcgagttattcaaacaatatttacccaaagcagataagttataccttactcaaattcaaacagaactagatggcgatagtttttccctcaattgaattgggaggagtgggaaattgaatttgatgaatatcgtaaggcagatgccaaaatcgctatgatgccgatttttattttttacccgaaaataaatcaaataaatgaancaatacttctagaacattcattaatctagcaaaaacaaagagatgataatttccccttgagttcccctttttaaagtttcataatgacctttcattttatttttgatagttttaaatatcccatttttaaacattatcccaaatcagggaagacattatgacgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtaccctgtgcgaataaattagatccacaacaatttacagaaacgccattgagaattggtctttctgcaacggcaaaagtaagaatttcagattcatcaggcgcaatgctacgagaaaaaacagaaccgaaaacgttttttctactgatacacttaaatatgagaaagtgcgtagaaaaggggtnctntagagtcgactgcaggcagcaagctgtc

SEQ ID NO: 438 - DNA, 4151 bp, H. influenzae
gacaaatccaaaacatttttcaacgccaatgtcgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagtttgatacacgagcaacaacgcttacatcctaaaccaaagaaaaaatactaccgtccacgccgtcgtaaaataacccgttcagcagagtaaggggagacacgactactgcataattgctctaggtagcaatttaaacacaccagtagaacaattacatgctgcgcttaaagcgataagtcagttaccaaacacgcatttagtaacgacgagctctttttataaaagcaaaccgctcggcccacaagatcaacccgattatgtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagcttaactcaatatatccctgatgaattttctatgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaattaacttatttatgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgattgtggggtaccgagtccgaattcgaatacag

SEQ ID NO: 439 - DNA, 4494 bp, H. influenzae
  misc_feature (4037)..(4037): n = a, c, g, or t
agagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgataccataccgaactcagaagtgaaatgttgtaacgctgatggtagtgtggggtttccccatgtgagagtaaggcactgccaatcatcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccattaaaaaacctttcattttcaataatttactacattgtaaaaattttcttgtgagaaataatcctattcttgtagtgtaaatgtgacatttattcataaactttattatgtgatcgcatttaaatacgtaggaatataataatttctaataattatttttaaataattttgaccagttttataattttacattagtatacgagtcttaattttgttgtaaggaataaaaatggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatagttttagattcaaaacaacaaaaaacgcacttcacttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagatcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgtgctgcaggtaacttgtttgttgcaataaaatgcgagtacgggcaatttccacgagcaaattatcagagccggctaattctgtcgcttcaattaaatagcgatttgcactaaattcgtcgccacgttgttgagcagcttctgctgctttgatgagatttagtacaggttcagcagaatgtttagcatttttgccaattaatttttctgctttagcgtaatccccttcattcatttttaccaagccttcaagggtttgtttttgcgcttttacacgtttgcgattagaaaaccattgataagagctacgacttaaacgaaagaaacgagtgatgccccattcaaaagcataaattattgctaaagaaataatgaaaaaaatcactaaggtagtgatggacatttctataatacgatttgctgtctcaatgcgcacataaccttgctgaccagaaatataaggccctgctacaagtcctacaagcaatgtcagcattaaaaagagcactctaaacatagacttatccttattgttgtgattcagattgtgttggtttaacagcttctactttaggcattgtatcaatcgccttgtctgcttcaatttccactttttgtagatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcacttttttcaatattttgttgccagtcagtaatgttgttggataatttatcattatttttagatgtttcatcaaaatttacattcaaagcctgtaattcatcgactgtgtttgcaagctgtgacagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaatttcagctatttgttgctgaccaaaatagtatccagctccaccaatacctagcgcaacaagtattgctaataaactcaatgctgtacccgtttttttcacaatagtttgcggaacagactgcattgtttcagcttgttcaacagctgttttgggcgtatctgtaaagtgttcagtgaggtcgntagggtgctcttttgcatatcaattccttataagtgatattgagtaagggattttatatactttgcgtgataagaaaatatcaagctatccactattaatagaaaatattagatttttatatcggcagaattaagctatttacgcaataaaatagtgctatcctaccactcttaggtaaaaaagcatttttgattggtgatagggaaaacctataatatattttaaaaaaattgggatttatgccacatttttttgcattattcttccctagtggaaatttgtccccaattttgttgttctggaggggccccccctggaattgatttatcccaaccaaacaatgggttagcgccttggatccccccccgttttggccgccttctcaaggtcagcgaatcttccacccccttaagcgatgcgccttttattttacccttaaacaatcgaaaattccgc

SEQ ID NO: 440 - DNA, 4085 bp, H. influenzae
ctggtatacgaatatcagcctcggtacccgatttttggtttccccgcagcgcgatacgacttgttgcgcttgaattaattctagtgctaacgctggatcacccgtagtcagttgaatttccactttaggataacgctggcgaaattctttaagtacgtgaggaagatggctataagatgcggttacagaacaaaaaagtttaatttcaccgcaaaattcatcggatttatctttcagttgttgtttaaattgttgccagttttgccattctgttttagcaaattgcaaaaatttctcgccatattcagtaagtttgacttggcgattatcacggataaaaagtgtcttccctaactcgtcttccaatcgttgaatttgacgggaaagggtagagggagacatgtggttttgggtggcagttttggcgaagttttttgtatcactgaggtggatgaatatttgtaggtcggtaaattccataatttcttcttttattttatttaatttcgggtttcgccgatggcgacctactttttctttgctcatgcaaagcaaaagtaggcaaaaagaaaacacgccctgctttgccttatttcctgagaaattgaaaacttgcttaacggaaattttctgaactcgctacgctcaaacagacgaaaatttcctacaagtttccaatttctcaggcggcaaagaagggaactaatttgttctttcttcaatttaaagtgcgggtaaaatttagcgtatttaaaaaaataccagaaaactaaccgcactttttaataacgctctgatatattctgagccccatataaatcgcctttgcgactttcaattttcaggcaatttgcgtttgtttgagcgtagcgagttcagcaaattgccgttaagaaaattgaaacaaagcaaagagctgcgatttaattggggcgtgttttctttgcctacttcttttacacgagtaaaataaagtaggtcgctcatcgagcgaaatacgatgcaatccccaaaaaaccaacataattgcacaaatcgcaacattacattcccataatatcactttacgcaacaacaaaaaatcctataatcaaaccacaacaaaaaatatgcaaacacaacatcatacaattatcaaccttacacaattaaggacaacaaaatggctaactatttcaacacattaaatttacgtcaaaaattagaccaattaggtcgttgtcgttttatggatcgcgaagaatttgcagatgaagcaaacttcttaaaaggcaaaaaaatcgttatcgtgggctgtggtgcgcaaggtttaaaccaaggtttgaatatgcgtgattctggcttagatattagctatgccttacgtcctgaagcaattgctgaaaaacgtgcgtcattccaacgtgcaactgaaaatggttttaaagtgggtacttatgaagaattgatcccaactgcagatttagtcgtaaacttaacaccagacaaacaacactctaaagtggttgctgatgtgatgcctttaatgaaaaaagactctgcatttggttattcacacggtttcaacattgttgaagttggcgaagaaatccgtaaagacattacggttgtgatggttgcaccaaaatgcccgggtactgaagtacgtgaagaatacaaacgtggtttcggtgtgccaacattaattgcggttcatcctgaaaatgacccgaaaggcgaaggcttggcgatcgcgaaagcttgggctgctgcaacaggcggtcataaagcaggtgttttagaatcttcattcgtggcagaagtaaaatctgacttaatgggtgagcaaactatcctttgcggtatgttacaagcaggttctatcgtatgttatgacaaattagtggctgacggtaaagatcctgcatacgcaggtaaattaatccaatacggttgggaaaccattaccgaagcgttaaaacaaggtggtatcacattaatgatggatcgcctatcaaacagcgcaaaattacgtgcatttgaacttgctgaacaaattaaagaaagccttggtttcttatattacaaacacatggatgacatcatcagcggtcacttctctgcaaccatgatggcagactgggcaaatggcgataaagatttattcgcatggcgtgaagcaacaggtaaaacagcctttgaaaatgcaccaaaatatgatggcaaaattagcgaacaagaatactttgataacggtgtattaatgattgcaatggttaaagctggtgtagaattagcctttgatgcgatggttgcaagcggtatttatgaagaatcagcttactatgaatcacttcatgaattaccattaattgcgaacaccatcgcacgtaaacgcttatacgaaatgaacgtagtaatttcagataccgcagaatatggtaactacttattctctaacgtagcaaccccaattcttgcaaaagaaattatacccaaccttcaaaaaggtgacttgggcgagcctactccagcagtggaaatcgataacatcaccttacgcgatgtaaacgatgcaattcgtaaccaccctgttgaattaatcggtcaagaattacgtggttatatgacagatatgaaacgtattgctgttgcaggttaatgttaaattgaactgaattaaaaaccgactttatcaatataaagtcggttttttcatagataaaattaatcataaaaatgcacgttaattacaacgtgcatttttcttatttaagcatccatcgacatacaaagtaaagttaatggatgaatacaagttacgttagatgacatatcaatttgccatttacaggtttgacattcagatataacgtaatcaaatccaccctcgttaatattatcgaatagatttttaccaatagattgtgaaatttcatagttttctgatttaaaaccgtaagtccccgcaataccacaacattggcttggtaacataatgatttctaaacccggaatttttttcaatacttccaaagtataaggtgcccaaccagctttatctacgtgacaagcggtgtgataagccactcgaagtttaagtggtttcaacggtaatgttttaccttctttgaaaagctgatataaaaatggggttaccatatggatatgcggacggactttggcgttgtcgatacctaaaatatgatggtattcgtcgcgtaaattaagcgagcaacttgatgcctcactaatcacatctattccattttcatctaccatttttccaatgtaatcggtattgaattgtgcaatattacgagcgcgattaggaaaaccgtttaccattaatggtaagccacagcatttttctttttctaataacattaccccaatattcattgcattgaacactttaagaaattctttgccaagctgtggattattataattaacataacaaccgtggaaatatgctacttttcgctcaaatttttgttggtcttgtaacgcatttttcatataccaactacggaacgtgccaaacgcatatttaggtaaagtacgttctttactgattttaagcgttttttccaacataaatttggtggcttttaggcttgtgatggtgtttacaatcggtgctaatggcgtattaattttacccataacatctgtgttacttaaaatcgcatcacgcaatttattcattaacggttttttagactgcgctaagtgattattacgcgcacgtacaattaaatcgccaattttcacatcagacggacaagccacttcacaacgtttacagttggtgcaatatttaagtgcttcatcataaagttctgctgattttaagcgtaaacgctcgccatcaggccctgattgttttggaccaggataaagcggattgttgcgtgaaaccggacaaacagcagtacaagccgtacatttaatacagctttcaaaactttcgtcgatatatttatggctttcaggcgaattaagggattgttttgcactatcaatgagtcgttgaatattattatccatattattcccctatttcgctaagatttcatctgccactgccaaggcagttacaa

SEQ ID NO: 441 - DNA, 4528 bp, H. influenzae
attccaacattcaactttcagaagatatgttttacggctctacctgtaaccccaaattccgtaatcgctttaaacatttcggggaataatgaaattacccctatccacataaaaagcctactacattacgtttgtgcatacttgagattagaaaccagcgtcccaatccacttcaattgtttttgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaattgtgcagtttcacggtcatcaacgccttttaatttaacgatgatttcgtgattatgataacgccagttttctaattcaattgattgccattcacctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttgcgatataatacgaggcatccagctgttttaggtcaaatttacgcgtatagcggtattttagcttgataaaatatcagttaaatgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaattaatcccttaccaataggagtttttatgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctataaaggttgaaaaatagggtgatttattgcgataatctaccccattttttgggagatctttctatcttctgcatttttacgcagtttattttcattagaaatgatcgaattttatttcacttttaatttaattagataaaaaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactgggggggggagcgcgtcttctatggatacccgtccctattattcccccctgggcattgattttctcctacacccaccgccgcaaaatctcctccctgcccgctccgtttttattcccgcccttgtccctgccgcccgc

SEQ ID NO: 442 - DNA, 5389 bp, H. influenzae
  misc_feature (3534)..(3534): n = a, c, g, or t
  misc_feature (3608)..(3608): n = a, c, g, or t
tatgcagggatgaaacgccgatttcagtcatttgattagatgcgtaggattttaagggtactcgacatacccgaaaaatcgccggtagccctgaaggaaattatttcgatattttattacgcggtgcagaagaatctgatgagctaaagtgcggttagatttgtggcaaattttggtttccaaaattttttacggaacaacgttttggcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattagttgggtttgtggcggggttttagcccaattccttacaaggggtttacgctctgcgctggagtaatgcaaatggcatttttcccttttgttatcaccgcattttgtttcacgtttagcacgtttcttgctagtagcaaattagctgatggggggcggggaaaattccagcaaaattggcgaaatctattgagattattggctggtcagtggttgtactggctataatcgcttactttatactgaaaaactagaatagaaaatgaacaaattaagtcttgttttagtagctggatatcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataaaaatgaaataataacggaacaataaggaataactatgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgcttttacgtggtacggtaatttaatcatcatcaaacataatgatgatttcctaagtgcttatggcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaagatctctttanaaagtgcggtaaaaaatctcaacaaatttttaccgcacttttttattaaaaatattctgtgaggagtatcccanaataaaaaaataatagatgacaatgttaaattttatattattctgataatgcttcgtagttagaagtcagtgttaagttttattaagtatctcttctcttaaaaggagtttaatatgctcaacttgctctctcctaaccaaacttgggttcttgttgatccaagattatctttttattttcccataatttattaatcctttcttattaaccatcaaagtgttttcattttagaaaataattttttatttaaactaagcaaattaatttttggggattttgctatggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggaggtttagaaggtggtgcaatggaacgtttggctgttggcttgcatgatggtatgcgccaagaatggctggcttatcgtattgcgcagattgaatattcggttgcaggcttacaaaaaattggcgtgccttgccaacaaccaggtggacacacgacgctcgtagatgctgttaaattattaccacatattgcaggcgaccaatttccagcacaagcgctttgttgcgaactttatgacggtgcaggtacaagatcgtaagaaactggctcatttttattaggacgagattcgaagacgggtaaacaactaccatggtcagcggagcttctacgcttaactataccacgtgcgactgatacgcaaacgcatatggatttcattatgtgacgcttccattcgtgaaagataatgcacagatattaatggcttaacctttacttatgaaccaaagctctccgccactttacgggacgggtaaaaaagatgtatgactcacttaaaatgcagtccttttgaactgctttttttatcaacagatactgaataattgatttgaaatgatgtgctaggaaaaa

SEQ ID NO: 443 - DNA, 6250 bp, H. influenzae
  misc_feature (5866)..(5866): n = a, c, g, or t
  misc_feature (5940)..(5940): n = a, c, g, or t
  misc_feature (5978)..(5978): n = a, c, g, or t
  misc_feature (6009)..(6009): n = a, c, g, or t
tatataggtaattcgtttcaattgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaataagatgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaataatgaggcaatatgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatggggtagttattttgagctcactcttattaaaaagtaaaagtttggtgagaatgtattatttctcacttcactttttatgccataaatcaaatgaaggagtattatgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaattttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaatgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaatgataatacgcgttgcaagtattagctgacacggtagtaaataacacatcagaaaatcgaaaatagcgggctagtggagagcttagatacataaaaaacacagcttggtagtttttcacccatctaaacttatattatttagattatgtagcagttgctaaatcacctaaatctttatcaatcaagcataaatctttaaatgctgcagtactttcacacccatgaatcgaacactgtaaataaacatcatagtatggctctaaattaatttactcgttcatcttatttgattaagtataactaattaagagaggagaaataatctctttataacctataattaaagttactttgcatttttacaatttaacataatatacattatgcgaaattagttatcaggttagcggaaactacggattaaataaatcacacagttatgcacaagtcacaggtactagcaaaacaagacaaaataaggctagataacacgttgtaacgcgtcattttatagagttattgaacggatgaattgaaatgtaaaggaaatgtaaagtgaaataagcttaaatctatgtgattacgctacgtaaaatctggagaatttcttggatattttcttccctgaaaaacaacaaaaaaaagcacgtttttattaaaacgtgctcttctaaaaaatgtgacaacgtatcgactaacctagtaattttataccatattcatatacttgttgtagcaaagatagtttttcagaattatctgaatgttcctcggctaaacgttgtaaacctgattgaaactctaccgcacttttttcaagtttattctgtcggtatttttgccatttaatttgttcagcgcgtgtgagggttttataaaagtggcgagcacgataatggaacaataattcaaggatacgtttatcttcaaaagctaaaccatgttcagataatttttctgcaggtaaactacgtaaaatagccatattatttttatcagcattgctaaaaaagccattgtataactcagtttctacattatcattcgatgcaaattgacgttcttcattaaaaatatccgccactttttcacgaatatcaaaagatgctcgtaattttgcaagattatccaagcataattgtcgatcaatacccaatcgatttgctgtttctggtaacaaagttttagctggtgctaaaataggacatttattaatatgcacaagttttaacggaacggatgaaactcctctttcttctaattcagattttttggtatataaatctgtccgtaattcatccgcacttttggctaataaattatcgatatcgccagttaaatcacacacaattaatgcattttgatttgtcggatgccaagataaaggtgcaacccaagtgcaatttccacgataattccctagcattccagaaacatgcactaaaggtgtcattgcgcctgtatcaactaatttttcgatttcttttttaccgcgattttcaaagaaatattggaataatttaggctgtttttctttaattaatttcgccatagcaatagttgcatatacatccgccatggcatcgtgagcattttcatgctcaataccatttgctttagtgagtttttctaagcggaaacttggcattccatcatcgtcataagcccaattaattccttctggacgcaaggcataacaggctcgcactaaatctaacaaatcccagcgtgaattcccatttttccagctgtattcataaggatcaataaaattacgataaaacgtataacgcgtcatttcatcatcatagcgaatattgttataacccatgacacaagtattgggttgggaaaattctgctaagatatttgcggcgaattcaggctctgaaagccccttttcattacattcttgaggcgtaattcctgtgaccattacggcttcaggagccggtaataatcgntggggtttgtttacaataaaacttaattgggttaccaatgatattaaaatcagcatctgtacgaatacccgcanattgcgcaaggcggatctgttgcctgggattacaccanaactttcataatcgtaaataaaaaagctganatcttttgccatgactactctcttttacgcaatagtttatctaaatatataagcagaaatagccgataactaaaatagacctagccatttacttactggattttttcttaaaactaaggcgccggaatcgacctaggcaataacccgatattattccgcgaacagcgggggattcagaaaaatttgatggctttataataaaaaaaattaggaattcatccccaaaacagcgcatacctgg

SEQ ID NO: 444 - DNA, 3273 bp, H. influenzae
  misc_feature (3028)..(3028): n = a, c, g, or t
ccgttattggtgttttagcaggttgtgaaatctggccagatggcaatgcttatcgcccatgcgatattcttaccactatgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtaacactatgctgaatgtgcggtaaattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaaaatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcattagcacaattgcaacaactgacatcaaagtgccccacattatggcttgccacgcaggagaagctaaacttttatctcgagatgcaatgttatttaacacataaatacctgaatccgctgaagtgataaaaaacaatgaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaaaagaagtaaacaaaatgctaaagttaagttaatttcacttaatattttcacgccttttccaataccagaaatagcagaaaacaccgctaaacacatcaccacaacaataacgccaacttgtaaggaaaagctgttctgacttatccaacctatttgttcaagccctgcaccaagctgtgatgaaccaaaacctaatgtagtaataatcccaaataatgtggcaagtaatgccataacatcaatcgcatcgccaattttgccattaatacgatctttttataaaggataaaaaccagagcgcaccgttaaaggtaatttataacgaaaccccaaaattagctaatgctaaagcaatggtgccatatactgcccacgcgtgatttccccagtggaacaaagtatgaagtaaagcctcttgttgtttatgttctgcaggaacctactgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtgagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgtatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattntgcccagctggacgataaaaacgctgtccaagttttttcaaatcttcaggttcaacgccaccaccattgtcctcaataataatctgggaggatgaaatttttactggaacgattgtatcttcaggacaatatttaatagcattggcgagtcaatttctaagcttcatgaaacttacattggctgccctctgttttggtttgggtcaaatctttctcaaacccaggtattttatgttttttcgccc

SEQ ID NO: 445 - DNA, 3832 bp, H. influenzae
  misc_feature (3631)..(3631): n = a, c, g, or t
gagacccctttcgtaaggtggaaagagaaatatatgaaaaaaacaatgttattaaatgcacaactttctcgttgtatcgcttctgttggtcacacagaaagtttgacgatttgcgatgcgggacttccaattccgttaagtgtggaacgtatcgatctcgcattaactgcgggtgtaccaagttttctacaaacgttgaatgtagtaacgaatgaaatgtatgttgaacgcgttgttattgcagaagaaattaaagaaaaaaatccagaaatattgaccgcacttttaacacaacttcaacaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaatcagggtgaaattatggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtacatgttggcgcgaagaaagaaatttgtcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataagagtaggtaagtatgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaactcactttaaggagaaactatgaaaaaactaaccgcacttacttctgctgtattattaggtttggctgtttctggctctgcttctgcacaagacacaatcgctttggcagtatctacattagataacccattttttgtaacgttaaaagaaatggcgcacagaaaaaagcggatgaattaggttataagttagtggtgcttgattcacaaaatgaccctgctaaagaattagctaatgtcgaagatttaactgtgcgtggtgcaaaaatattattgatcaatccaactgattctgaagcagttggcaacgcagtggcgattgcaaaccgtaagcatattccagtaattacattagatcgtggcgcatctaaaggaaacgtactgagccatattgcatctgacaatatcgcaggtggtaaaatggcaggcgattttatcgcacagaaattacgcgattaatgccaaggtgattcaacttgcaggtattgcattaacatctgcgtcctcgatcgaggtgatggcttccacaagctattgttctcacaaaactatagtctttttactcttcctatatatttgtcggttcttttggtctgttgtctctttctttctttttcacttattgtttttttgctcttttttctggtttttttttttatctctccttcttcttttttgtcgttttcttctttttttttnattcccttctctcttttttctttttctttttccccctttttttttttctttcctttttttttttttttcttttctctttttcccctctttttttcctctccccttcatctctatcctccccttaattttcttattattctcgttactctccttccctcttcccctcttctcttcacatttaattctctatttctttctgtt

SEQ ID NO: 446 - DNA, 4166 bp, H. influenzae
tggtatacgaatatcggactcggtacccaccctattaaaaaatactccaagtttggaaaaacataaaatattccttataaaaaatcgctaaaaaactaaccgcactttatttcagtgtttgagctaatgctttaacccaaggacgttttgcatcttctttcaataattccacgcgataacgaactaaagtaagccaaatatacaaggtcaaaaaaccgaagatacataaaattaatggaaccaacattggaattgcaatggatggtttttcaaatttggtaatactcgccccttgatgtaatgtgttccaccactccaccgaaaaatgaataatcggtaaaatcacgaccgttgtaatgcataaaatccccgccgcttttgcacctatgttacgatctgaaaaagcagaataaagggctaagataccaagataaagaaagaataaaatcaattctgcagttaagcgagcatcccacacccaccaagtaccccacattggtttcccccaaattgcccccgtaacaagcgataagaaagtaaacaatgcaccaattggcgccattgcaatcattgcgagatgagcttgcttaatttgccacactagggcaaccacagctgcaatcgccattgaaccgtacacacccattgaccaaatcgctgtcggcacatgtacatacataattcggaaactattgccctgttggtaatctgctggggcgaatgctaagccccatacaatgccaataccgagtaagataagcgttaaaaatgcaaataacggactcaatttaccgcagatacgatattgagtttcaggttttgcataaggatgtaaccacttccacataaaaaagatccttaaaaattaaagagaaaaaccaccgcacttttatacaatgaaataaaattaattatctaaactaattcgcaacgctgcagcaatggcaaaaggcgaaagcgttactgcaccaaccatcatggcacctaaaatcgccagttgtcccccataaggcacatttaatcctgctgcttctagtattgatgaagcaaaaattaaaacaggaataaacaacggaacaacaagcaaactcaacaacacgccaccttttcgcaatcccaccgttaaagccacgccaatagcaccgatacagctcaatacaggagtgcccagtaacaatgtcaaaaccaatgcccaccaaatattgacctcaagagaaagcaacaaagcggcaataggtgatagcaaaataagcggcaaaccagtgagcaaccaatgtgcaacgactttagccaaagctgtcattggcaaaggctgtgcagttagcattaattgttcaagagagccatcaataaaatcatcacggaataaacgttcaaaagaaagcaatgctgaaagtaatgctgctacccatgcgatacccggtgcgatacgggaaagtaatttaggctctggcccaataacaagcggaaacaaagtaatcacaagcaaaaagaaccatagcggatttaaaatctccgcatttttgcgcattgcaatttgaagttctcgtttaattatctctaaaaaaatcattaagttattccgctttataagccgctaaattcaatttttgcagatgagaacttggcacttcttggtggctggtcaataacacaatacctccacgttgagcatgctcatcaaaaagtgcggttagaatttccacgccttttttatcaatcgcagtaaagggctcatctaaaatccataagggcgcttgagacagccataagcgacctaacgcgatacgtttttgttgtcctgcagaaagttgtgcggcaggcaaatcttcacgccctaataatcccactttctcaagcaaatcccacaacatatcggtgttttgttcagcttgactaattcgttgataaaactgcaaattttcccacgccgttagctctggtttaacgcctaaaagatgtcctaaataaagcaaattctgatgatactgttcacgttgtttagaaattgcttcagcatcccaccgcacttcgccttctaaaggttgggctaaaccagcaagaatacgtaacaagctcgttttacctatgccgttatgcccttcaatttgtacaaaatcaccgctattaaaatcgcaagtcaaagcacgaaaaagtacgcgctcaccacgttggcaggataaattttgcagagataacttgtgttgctcaaacataattacagagggaaaatagaaagtggtggtattctaatatttgatgaaattttcgcaactcaaacacataactctttagaagtagatcgataggtttattgatttaaaacaaaatttaataaattcactttttaaaaaaggaaaaacatttaatgatctaaatcaatttttttgctattatttgctcaattttggttatagaccaaaacctcaacgaaatctgtttttaacaatagaaggaatacattatgtcttacactctccctgaattaggctatgcctacaatgcgttagaaccacattttgatgcgcaaacaatggaaatccatcatagtaaacaccaccaagcttacgtaaacaatgcaaatgctgcattagaaggtttacctgctgaattagtagaaatgtatccgggtcatttaatttctaaccttgataaaattcctgcagaaaaacgtggagcattacgtaataatgctggaggccacacaaaccacagtttattttggaaaagtttgaaaaaaggcactactttacaaggcgcattaaaagatgcgattgaacgcgatttcggttctgtagatgcatttaaagcagagtttgaaaaagcagcagcaactcgtttcggttcaggttgggcatggttagtattaaccgctgaaggtaaattagccgttgtatcaacagcaaaccaagataacccattaatgggtaaagaagtggcaggttgtgagggtttcccacttttaggtttagacgtttgggaacacgcttactacttaaaattccaaaaccgccgtccagactacattaaagaattctggaatgtggtaaactgggatttcgttgcagaacgttttgaacaaaaaacagcacactgtaactgtgcaaaataataaacataggaaaacctagcaaaagttaggtttttctgctttcctctctataacttttcttttgcaatcttttttatcaaatctgtatcttttacaggcttattatttataggcatttatcaatgtttattttccataaacaaagtattattaaaattcaataaataatgaagaaatgtaaagcttctttagtgaggtcaaaaagaatgttactatggcaaaattttaagttattaaaaatagaatttatcactattttttataactatttttatgaccacattaaagttaagccaaaaaaatgtgttgctataaataacaaaacttaatctttaaattaaacgaatctaactttttaaggtcatataaaactgattgaactttttatttataaacgagattttaatgaatcaaaatctaattgaagttaagaatctcacctttaaacgcggtgatcgcgtgatttacgataacctgaatttgcaagtaaaaaagggaaaaatcactgcgatcatggggccgtcggggattggtaaaaccaccttacttaaattgataggtgggcaactaatgccagagcaaggtgaaattttgtttgatggacaagatatttgtcgtctatctaatcgtgaactgtacgaagtacgcaagcggatggggatgttattccaatcaggtgcgctttttacggatatttctacttttgataatgtcgcctttccaattcgtgaacatacgcatttgcctgaaagtttaattcgtcaaatcgtgttgatgaaattggaggcggttgggttgcgaggtgctgccgcattgatgccttcagaactttccggtggtatggctcgtcgagctgcattagcgcgcgctattgcgcttgaccctgatttaattatgtttgatgagccatttacggggcaagatccgattagtatgggcgtaattttaagcctgattaaacgattaaatgaagcgttaaatttgacttctatcgtagtgtcacacgatgggaggaagtatgagtatggggtaccgagtccgatattcggtacca

SEQ ID NO: 447 - DNA, 4248 bp, H. influenzae
tggaggaatgtgaacgtggggaccctcgaagacaccaaggtggggtacggggacaacggggcggaaaacgagtcgtaagggttaatgcagcgagcgtggggtaaactatgttctgatatacgagctaatcaaagtagagttaaacaagatccaaattatatacgtactattgttcgtaatgatttattgccttacgtaaacttagaatatgcaggttctaaagtattaggttcatactacgaatcaacctctacagagcaacgagaaaaatttttcaagacttttggtgagttgattgagcaaaagtacgcacaaacattaacaaattattctaatcaaaaaattcaaattgaatcagaaaaagaattaggcgataacaattttgtaaatattcgcgtaagtattattcaaactaatggcgttgctccgatcctattagattttaaatggcgtaaaggcaataaaagtggggaatggaaagcctacgatatggcagcagcaggcgtaagtatgctggaagatacgataaaaaattgggttggtattttaaacaaacaaggtattgatacattaatcacaaagatgcagcaatctgcctcacaacctataattttcaatcaataaatgaataactatgctaaattgggatttgcaaaaaaataatgataaaataacgctctttttgtttggggaactatctcgcagcaccttgttaccaatgtggcagcaacgtggcgtttttttgtcagaaagtacacttgataaaactattgttgaatggaatttatctggtcttcagcatattgattcagctggttttacagctctttgtgattttttacgagagtgtcaaaagattaacaaaacagtacgattagtttatccaccaaaacaattattaaccctagcagatcttgttggtttatctgattggatcgcaaattttacatagcttacttaaacggaaatccaatggaacttcaaaaaattgaacaaattttaaaagacacgctaaatatcgtagaagtctatgcacaaggtgaaaatgcacattttggtgtaattgtagtgagtgatgaaattgctgcactatctcgtgtaaaacaacaacaaacgatttatgcccctttaatgccttattttagcactggtgaaattcacgctctaaccatcaaaacttataccgtagaaaaatggaaacgcgatcgtgcattaaaccagtttaattaaggatttaaaaatggataaatttcgtgtttatgggcaatctcgtttaagtggaagtgtgaatatttcaggcgcaaaaaacgccgcacttccaattctttttgcggctattttagctacagaacctgttaaattgacaaatgttcccgaacttaaagatattgaaacaactttaaatattttgcgtcaattaggcgtaattgcaaatcgtgatgaaactggtgcagttttattagatgcctctaatatcaatcatttcactgcaccttatgaattggttaaaactatgcgtgcttcaatttgggcattggcacctttagtcgctcgtttccatcaagctcaagtctcattacctggaggttgttctatcggagctagacctgttgatctccacattagcggtttagaaaaattaggtgcggacatcgttcttgaagaaggatatgtaaaagcacaagtatcagatcgtcttgttggaactcgaattgtaatagaaaaagtaagtgtaggcgcaactttatctattatgatggcagcaacccttgcgaaaggtacgactgttattgaaaacgccgctcgtgaacctgaaattgtagatactgcagatttccttaataaaatgggtgcgaaaataacaggtgcaggttctgatcacattacgactgaaggtgttgaacgtttaactggttgtgagcacagtattgtgccagatcgcattgaaacgggtacattcttaattgctgcagcaatttcgggcggtcgtgttgtttgtcaaaatactaaagcggatactttagatgccgtaattgataaactccgtgaagctggtgcgcaagttgatgtaactgaaaatagcattactttagatatgcttggtaatcgccctaaagcagtgaatattcgtactgcaccacatccagggttcccaactgatatgcaggctcaatttactttattaaatatggtggcagaaggtacaagcattatcactgaaacgatttttgaaaatcgttttatgcatattcctgaattaattcgtatgggtggtaaagctgaaattgaagggaatacagcggtatgtcacggggttgaacaattgtctggcacagaggtaatagcgacagatttacgcgcttcaatcagtttagtgcttgcaggttgtatcgcaacgggtgaaaccattgtagatcgtatttatcatatcgatcgtggttatgaacatatcgaagataaattacgtgctctaggtgcgaaaattgaacgtttttctagaagtgatgaagcgtaattaggtacgcgacttttctataataaattacaagtttatttataatcttaaatttctattaatgcctttctttagaaaggcatttttttactgaaattttataagagtagattgattgcattgtttagaaacgtatttttctacaagaaagtgcggtagattattttcttattttgatagtaatcacttatatcaattttttataactaaaatttataaaccataaataaataatctttttttttcataagtttggtttttataatcacgcttagacaaacacaacacaaggaagaaaaaatgaaaaaattactttttacgaccgcacttttaactggagctattgctttctcaacgttttctcacgcaggcgaaattgccgatcgtgttgaaaaaacgaaaactttattagttggaacagaagggacttatgcaccatttactttccatgataaaagtggaaaattaacaggctttgatgtagaggttattcgtaaagttgctgaaaagctcggtttgaaagtggaatttaaagaaacacaatgggatgcaatgtatgcggggttaaatgcaaaaacgttttgatgtgattgcaaacccaaactaacccaagcccagagcgtttaaaaaaatacagtttcacaacgcccttataattattctggtggggtgattgtaacaaaatcatcggataacagtattaaatcatttgaagatttgaaaggtcgtaaatctgcgcaatctgcaacaagtaactggggtaaagatgcaaaagctgcaggtgcgcagattcttgtagtggatggtttagcacagagcttagagcttattaaacaaggccgtgcagaagcaacaattaatgataaattggctgtattagattattttaaaaaacacccaaattctggtttaaaaattgcttatgatcgtggggataaaactccgactgcctttgcttttttacaaggtgaagatgcattgattacaaaatttaatcaagtacttgaagcacttcgccaagatggtacattaaaacagatttcaattgaatggtttggttatgatattactcaataattggttggcgagtcttccatttatgagtgcagaacgagctgattatgtaatcagctcgttttggcctatgttggaagcagcaattttatacacattgccattggcagtcatttccttcttctgtggtttgcttattgcagtgattgttgcagttattcgtactttgcctagccctaatttacccttaaaattgttacaggctttatgtcgagtgtatatctctataattagaggtacaccgatgttagtacaaatttttattattttttatgggttacctgaagtcggtattactttagagccttttccgacagcgattattgcattttctattaatataggtgcttatgcagcagaaactgttcgtgcttcaattattgctatacctaaagggcagtgggaagcctcttatgcgataggtatgaattatcgacaagcatttattcgtacaattatgccacaggctttacgtatttcagtaccatcgctttctaatacttttattagtacagtgaaagacacttcattagcttctcttgttttagtgacagaattattccgtgtcgcacagaatattacggcagcgaactatgaatttattttaatttatagtgaggcagctttgatttattggattttactgttttgttttaact

SEQ ID NO: 448 - DNA, 2825 bp, H. influenzae
tggtataccaaatcggactcggtacccttcaccgcactttttgtaaacgtctataaaatagtcaaaatcttgttaattccacattgacgcgcataagcagatagcgcattagtttcttccacacttgggatatacgctgataacccagcttcatcacgtacgcctttgctatgcacgcagataatttttaatgccacatcaggataatttcgtagtagttgagcaactttgcccaccaaatgttcagcatcaaaaaaatgctttaaaaaaaccaaccgcacttcttccactttatttaatggcaataaggcagctaaattttgcaaattccgctccagtttatcgttttttatatgcaaacgctctagtatcacttgctgtgatacaatacctgcttgatttttccgatcaaaacaaagtgtttgcaagccaatgccctcgcctttgagatcaaataaaaatttgtcagtgacatcaattaacgaacaaacacgatcaaactcaaaaaagccactactatccaaataacaagtcaatccttgcgaacgtaaagccttaaagagtggcacaagttttttgtgatgaatagtgggttctccaccagaaaccgttacaccgcgaataaatggaactgcctccataacctgttcatacaaatactgcaaactgaccaatttcgcactttccgtataacgaggtatggtttccggattatggcaatacaagcaatttagcttgcaaccttgcagaaaaatactcgaacgattgccttgtccctctacatttgaaaaaggaataatccgatgcaacggcacaaaaatctcagaaagtgcggtcatttttctaattatttttcagcgatcacatctttttcattgcgtaattggcgatcaaacacattggcacattcatccgtacccgagccataccaagttgtatcgcgtaatgcaacttcgcctttacggtatttttcaacttcgcttttcttcactagataacctgtaactcgaattaaatctgtatttttcaaataggtggtaatgtagcgatagcctaaggaaaatgcgccatcaataatatccaccactgcatcgcagtgatctacataggtttgatcaaaggcgaataaatcccctgtaccagatgggaaatatttatggaacggtgcagattgtttcaaatgtgcaagtaacgttggttcttcgcctacacgaatacggtgagccggtgcgttacgcttgtcttcttcgtggttacttgcgcccacttgtgcgtgtaataaataacgattgccagtacgttcggcataaactccttcgtgcgcatcagtaatttctttcaatttatccataatcgcagtggcaatttcatcgccacgaacgctcttaccaaaggtttcatttaagccttcacattgcaataagtggtttgctgcatctgccaagcccacaattgcgaacatccccgtaaaattagtgcgtttgataaatccctctttttcgaggaatgaactgttaaagaaattactttcttccactacaaatttgtggcgtttatccatggttgaaagagcacatttcgccacacgcggtaataattcattcagcatttcatccgcacttttacaggtgcgagcaattgtccctagacgtaaacgcgttaaggtgtaggcgccgccacattcaggcagtgcgttatagcaacttgctacgccgtattcttcgcctagatcggaaatatagtaagcatcgttggcaaaagatggtttagaaaccaacaaacaggcttttgctgcaagttcagcaaaatcacggcttgttttcgatttgtcataacgaatagtcatattcggtgttggcgcttcaagctcaatcacggcgcgtaaaatcaagcgacctgctttcgtatcataaggcccaatattggcatgacagaatgagtcaggcacagttttatcaatatgatttaagaaacgtttaatttttatgtaatctttttcttcatcagtaatgaacggttcgagcaacacatcaagacgcccaacataaacaggataagtcgtaatggatggcacgcgggagtaaagaatcaataatccatcaagtgcctcatcaagatcttttggaggcggcaactctaaaaattcgcagcccttttggatatacacattgtaatcaggcaggatataacgaggacgataaatcgcgtagccttcacataaatcacaaatcatctgattctgtaaaaagccccattcttcatcggtatagccaagtaaatcgcgaggatcaaataaacgctcggcaatattgcctaatgtcattaatttttgatgataagtcagattattggctttaaccgtatcgagaatatcttgaagtgaagctaacataacgtcccctttgaaaatggtttcgtattgtacgcaatggtaacaaaatagacaattttgaaaacgtgaggaagatcacagttttagaaaataaacattatgcaaacggttactcaaaataaatatgtttttgatataaatgaactgacaaaattatttctgtttttgcatctttccttttatgataaaacggaatataaaaggtaataaatatgaagaaaaaagtacgcgttatacctcgcacatcttgggctgccacatcattatggaccgcgcaatataaaaccatttcaatcttactttttgctctttctattttaggtattggagatgggcttattgtattatcaggtttaggatcgacaccttggactgtacttcacaaggtatagcaatacagacaaattttgatattggctggtcttctttttaa

SEQ ID NO: 449 - DNA, 3469 bp, H. influenzae
tggatataaatagtgtttgcaccttttattaaattccatggggagtggggatggccccattatgggtggacgtgcattataacgtctatccaccaaaagttggaatacagcttggcacaacaaattctatctggtgcgttattcctggtaaggttgttaccattgattacgccaacgcagaagttcaagctagacaataggtattaaaaaagtgcggtaaatttaccgcacttttcttatgaacctaaacgctgacgtgcaatttcaaataaacatacccctgttgcgacagatacatttaatgatgaaactgaaccagccattggaatactaatcagttgatcgcaatgttcacgcgttaaacgacgcattccttcgccttcggctcccataacaagtgctagtggtcctgtcagtttgctttgataaatggtttcagtggcttcgccagcagtgccaaccacccaaatattatggttttgctgtaaatcgcgcagtgtgcgagaaagattggttacacgaattaacggcacggtttctgccgcgccacaagcaactttacgtgcgatagatgttaattgtgcggatttatctttcggtacgatcactgccactgcgcccgctgcatccgctgttcgcaggcaggcacccaagttgtgtggatccgtcacgccatccaaaactaataaaagcggattttgtttattcgcaagaatttcatcaagatcattttcattaagttcttttgccgcttgtactcgagcaatgacaccctgatgaacctcaccatcggcttttttatcaagtgtttgtcgattaacaaattgcacaccaattcccagggaataaagctcatttaagagtggctgtaggcgtttatcttcacgtcttttaagtacgaagacttcaattagacgctctggcgaatgggttaaaatactattaaccgcgtgaataccgtagatttgttctgacataaatttctctttttcttatttgaatttttaattcatttttacaataggaagtgaattattttcgttttctagatgctttcttcaaaacatctttcttttttaccgcactttttcgtttctgggatgttttagacggtagttctttaaagactttcttggctttttctttcgccgtttttccagcacgacgaggtttacgttcactccccatcagcgagaaatcgaccattttattttctaaatgtactgcttcaactttgatacgaactttatcgcctaagcgatattgcattccgctattttcgccaattaaacgctgttttgctgcatcgaattggtaataatcgttttctaaggtggaaatatggactaaaccatcgatgaataaatcatctaagcgtacaaataaaccaaatccagtcacagatgaaataacaccgctaaattcaccgccaacatgatcttgcatatattcgcatttcagccaatctgccacttcacgagtggcgtcgtcggcacggcgttccgtcattgaacagtgattgccaagtaaatccatttcatcaaaagagtaatgataaccgcctgtatcggtggttttacgttttgcgccttgttctttagcgagtaaatacttgatacctcgatgaagtgttaagtctggataacggcgaattggcgaagtaaagtgtgcatattcttccaaagccaaaccaaaatgcccaatattatcagcatgatagacggcttgacttaatgaacgtagcaacattgtttgaataagttcatgatcatgtcgttctttaactttttctaagagagcagcatagtcttttgtggttggcttcaatccaccttctaaggttaaaccaaactcacttaagaaagtgcggaacgatgttaatttttcttcgctcggggtggcatgaatgcgatataatgcaggttctttatgtttttccataaaattagctgctgcgatattcgcaagaatcatacattcctcaatgattttgtgggcatcattgcgaacaacgggttcaatacgctcaattctccccattgcattaaaaataaacttagtttcaatggtttcaaaatcgatcgcaccacgttgatgacgtgcaccaagcaacgcttgatagagtttataaagatcttctaaatgaggcacaagcgtagaataacgagcgcgtaattcttcatcgccttcaagcatttttgctacttttgtataagtgaggcgggcgtgagaattcatcactgcttcataaaagcgataatctatgagcttacctttggcagaaatttgcatctcacacaccatacacaaacgatccacttgtgggtttagagagcataagccgttcgataaaatttcgggtagcataggtacaactcggttcggaaaatagaccgagttaccacgattatgcgcttccacatccaaagcggaacgtaaacgtacgtaataactaacatccgcaatcgccacccaaagtttccagcctttgccgtgtttttcacaataaacggcatcgtcaaaatcccgcgcatcttcaccatcaatggtcacaagcggtaaatttcgtaaatccacacggcctttttttgcttcttcaggcacttcttcagtgaatttttttacgtatttttccaccgcacttggaaacttatggggaatatcgtggttacgcaaggcgatttccacttccatttctttcgccatattatcgcctaggatctctgtgattacgccaattggctggttaaaactggcagaacgttcttgcaactcgacaaccacaacttgtcccatgcgagcaccattacgatgttcatttggcacgagaatatctcgaccaattctgctgtcatcaggcaccacatagctaaaaccgttttctaagaaaaaacgacccacaatttgttttttacggctttctaatacgcgcacaattcgcacttcacggcgaccacgacgatctaatccagcaagttgcgctaagacaaaatctccatgcatgactctttgcatttgatggtttggaatgaataaatcatcctttttgccatcgacctgtaaaaaaccaaaaccttcgcgatgaccaattaccgtgcctttaaataaatctaatttttctggtaaggcatagcgtttacgtttggtgaacactaattggccatcattttccatcgcgcgtaatcggcgacgcatcgcttctatttgctcttcatttcgaatggaaagtgcggtcaaaatttcatcccgattcatcggtgcattattgtctcgaataacgcttaaaataaattcacggctcgggattggattgccgtatttttccaattctcgtttgtaatgaggatcttggctgattaagtttttacgtttttttgtcatattttttacagttttaaaaagtgcggagagtttgacacgtaaggaggataatgcaagccggggggtaccgagtccgaattcggaacca

SEQ ID NO: 450 - DNA, 3957 bp, H. influenzae
atttttatcggaagtttgaatattcaaacaaattatcaggtgtcattctatcgaaaaacagtatcgggttgaaagggatttttgcgtgctaaattcaatgatttccagtagaatgaggtgcttttataaataaggaataactatggcaagagaatttaaacgtagcgatcgcgtcgctcaagaaatacaaaaagaaatagcagtcattttacaacgcgaagtgaaagatccccgtattgggatggtgacggtttctgatgtggaagtgtcgagcgatttatcttacgcaaaaatctttgtgacttttttattcgatcacgatgaaacggcaattgagcaaggcatgaaaggcttagaaaaagcatcgccttatattcgttcattactaggcaaagcgatgcgtttacgtatcgtgccagagattcgctttatttatgatcaatccttagtggaagggatgcgtatgtcaaatcttgtgacaaatgttgtgcgtgaagatgagaaaaaacacgttgaggaaagcaactaatgtctagacctcgtaaacgctggcgtgatgttgatggtgtgtttttgttggataaaccacaaggtatgtcatcaaatgacattatgcaaaaggtgaagcgtttatttcaagcgaataaagcagggcatacaggtgcgctcgatccgttggctacgggaatgttgccaatttgcttgggtgaagcaactaagttttcacaatttttgcttgatgccgataagcgttatcttgttacggcaaaattaggcgaacgtaccgatacttccgatgcggaagggcaagtcgtggaaactcgtgaagttcatgttgaaactccgcaaattttgaccgcacttgaacaatttcgtggcgatattttgcaagtgccgaccatgttttccgcactaaaacataacggtaaaccgctttatgaatatgcgcgtcaaggtattacggttgagcgtgaggcacgtccaattacgatttttgaacttaattttattgaatatcacgcaccttttttaaccttagaagtacattgttcaaaaggcacttatattcgcaccttagtcgatgatttgggtgaagtgctaggttgtggcgcacatgtgacaatgttacgccgtacagccgtagcggattaccccgtagcagaaatgataccaatcaatgagttacaactgctcgctgaaagttttccattaagtgaattagatcgtctattactgccaaccgataccgcagtaagtaaattgcccgctttgcatttggatgtagagcagagtaaagccattggttttggtcagcgagtgaaatttgctaatgaacagcaattaggtggccaagtgcggttattttcagcggagaatttattcttaggcgtggcattaatcgacgggaatattattcgcccacaacggttaattacacaatctgcataacttcattgcctttcttataaaattctagtaatctcatctgtaattaattttttacaatatatgtaaactaaattttgcaggtgggttttatggaagtccttaaagatttacgttctgaaattgattcgcttgatcgcgaacttatccaactttttgctaaacgtcttgagttggtttctcaagtcggtaaagtgaaacatcaacatggattacctatttatgcgccagagcgtgaaatagcaatgctccaagcacgtcgtttagaggctgaaaaagcaggcatttcagccgatttaattgaagatgttctacgccgttttatgcgtgaatcctatgccaatgaaaaccaatttggttttaaaactatcaattctgatattcacaaaattgttatcgtgggcggttatggtaaattaggtggcttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagacattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccattaatctcgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattctgaacaattcttaaaagaaagccgtcagctattacagcaggcaaatgatttgaaacaagggtagagaaaagtgcggtgaaatttcaccgcagttttttactgtctcgccaatcttaaattttcaggtaaattctcaaaattagagcggaatggattaatgtctaatccgccacgacgagtatagcgtgcgtaaacggtgagtttttctggttttgcgtagtgcattaaatcgcaaaaaatacgttcgacacattgttcgtggaattcattatgctgacggaacgatataacgtaacgcaataatttttcgtgattgatttttttaccaacatagtgaatatgcaaggtgccccagtctggctgattggtaatgaggcagttagatttcaataaatggctgactaatttttcttcgacaatttcatccgatacgcaatctttcagccaattagcgttaaattcgtagctagtaatttcaatatcttgttcatcaatgcaatcgccttgtaaatgctcaattttttgagcatcataaactgccactggatttaaccgcacttttacatcgccttgcgcacattcgattaaatcgcgttgcatagtttgttgaacggcgttgaagtcggtaaatttgctttggttaaagctatttaaataaagtttaaaactttttgattcaatcaaattttggctttgataatccagataaatatctgcgatagccacttgcggtaagcctttttcgttgagccacgagatttcataagccgtccaaatatcggcgccgatagtaaatggttggttttgagtaatgcctaatccatcacgatttaacgcacgtggcacaggctgtaataaagtgcggtcatattgagaggcgtattccgttttttgaccgagttttaaggattttaagctgttgtcttggtaattcatcttttctccgattaggtgttcgacttttgcaaatttcgacactttataaattaattacaaaaaaattccacgatagattcgaaacgaatcgacaggtatcgcatttaaaatgaaaggtatcaaaaatcgcgttttttaacgcccaatttgcaccacaagaagggcagcaacgggatttttcagattttaaagattgcccacctacacgatataaataatagtaagtcggtatgccagtttctttttctatttcttgagctaaatatcgtccgtgttttgaaagtgtgctttggtgctccgaaatttctgccaaagattgttgttctaataccgcaccattcatttgtagttgatcgcaggcttgccaattttcttgccatttaatcagatcttggcttaagtgcgggtgatttttcaactgt

SEQ ID NO: 451 - DNA, 3057 bp, H. influenzae
  misc_feature (3042)..(3042): n = a, c, g, or t
tgttcgattcggctcgtacccatcttatggcgagccagtagaagttgtgacaaaaggtcgtcacgatccttgtgtgggtattcgtgctgtacccatcgcagaagccatgatggcgattgtcttattagatcatctattacgttttaaggcgcagtgtaaataatcttagtataagatgggagtctgtgcctagggtaggtataccctaggttagtttgatgttacccctttgggataagtggaaagttccccaaaggggaactattttttctaaccgtgggtatacttacccacggcaaaacctaagatatgcttacccatagcaaaactttagaatgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaatagcattaaggtaaatcaatatggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaaaaatagggtttgaaagtcatattccgaaaacggatatcaataagggggtaccgagtcngatattcgtataaca

SEQ ID NO: 452 - DNA, 4821 bp, H. influenzae
  misc_feature (4675)..(4675): n = a, c, g, or t
  misc_feature (4694)..(4694): n = a, c, g, or t
  misc_feature (4734)..(4734): n = a, c, g, or t
  misc_feature (4779)..(4779): n = a, c, g, or t
  misc_feature (4809)..(4809): n = a, c, g, or t
ggggagggggtgtgtgcaagagcgggcgtaggagtcaaacgggaccggtttatgcaagatagcttgggcttttggggactcagaaagcccaaatatttttaagggggcttccgtttgaaaaagtgtttgccaagatgtcacaaaattctaatgcagtgataggctcgccatttgaccattaagcttttcccgcaaagtgaaaatccaagttttattgtcttcggtttgccaattttgggctacagctggaacaagattcctttgcacatcataagccgttaatccttcaaaaagatctcgtaataattgagtttgttcttcgctttgtgcttgccaaggttgcaaagtcaaatcgctataaacgccacgttttaattcaactcggttagattctaattgagtatttttttgtgtctcaatttgtggcgaaataggcttaggactatccaatttatcgcaagcctcccccgtaaaaataatagaaaaaatagccgcacttcgttggcacaaggcgaacaaattattcattttcggttttaatccaaaataagaagaaccaaaacttaatacaaatcaacgcaacaataacactacgccctattacacttggcgtgaaataaaaaccaattagtagcattgtggtagcaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaagaaaaatcccaatgatgccaattgcaagtgaaagaaaacctaaaataatgtaaataattttcataatgttcctaataaaaaagaaaatgcaaactattattactgattttttagatttttcaaccttgatattatagaatttgccgtcacataaaaaaacagttttcaaaaaaggaacatttatgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaaagaaattcttacattacgcgtggaattggcgaaataccctcgggtttaatacttacaccgaactctcacttgccacaaaaatgggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaactaatacgtcaaactatagggcatgcacaacatgccctttctcaaatatttttctcgacataaaaacatagtaaattttaaccgcactttatccaaacaaaacctacaaacgagacattatttttacaaatagctgtaagataaacgcatagaaattcacgcagaatagactaatttcctgtataatttttcacatatctattcaactcattacacaaaatattctgaggattttatggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatggataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaagaacatattgagcaaattctcaaactgtttgccaataaagaagatgtgccgcatttggcaaaatccgtatcctttgaagaaatcgcccaaaatgacncacaaccttgcagtaagtncgtatgtggaacaaaaagatacccgagaagaattaatatntgatgaactcaatgctcaaattcgtgaaactgttaccaatattgnaccgcttgcgtgccgagattataagattgntgcaaatagaga

SEQ ID NO: 453 - DNA, 2984 bp, H. influenzar
ccagtcatcgcacctgtattgcggcaatgaattgtcatcacatccccagtgggtagttcaatatccgcaaaaaagcgtttgtaacgacgaatttaattttgccgattgtaaagctggaagttgcataaagttccttatttaagtttttctaaacgttgtaaaatggcgttatcgctcatggcctgcatttttttcattctcaaagaaagtaagaacgccgcaaaagtgagtgagaccacaaaagcaatccagaaacctttcgcatcaatatgtggaataagccaatctgtacgaccgagtgtgtaaccaagtggcacaccaattacccaataagaaaaaagggtaatgtataaaatcattttggtatctttatagccacgtaaaatgccaccaaccaccatttgaatggtatctgaaaattgataaagtgcggcaaataataataaatttgccgccattgcgatgacaatttcatcggttacgaaaatagaggcaatttcataacggaagaaaatcgtaattaatgcagtaataatcgtcaccgttagccctaataataatgcggcatagccaattttcttcgcattttgtggagaacctgtacccaacgcttgtccaactagaatcgtcgctgccataccaatcgacatagggaacataaaaataaaagaactggtattcaatgtgatttgatggcttgcgacaatagttgcacccagcggagaaagcattaaagacgtaagtgcaaataacgccacttcacaacaaattgcaatggcaatgggtaatcctaaacgcagtaattttttaagtgttttcagatttggcatttcgattaattggctaaatacttttagtgaacgttcttgagcattcgtataggaataaaaaatcatcattaagcacattgcccagttcacaatagctgttgcaataccacagcccaccgcaccaaaagcaggtatgccaaattttccataaataaaaatgtaattaagtggaatattaattagcaaacctaaaaaggtaatgaccatcgcaggcttagttttagcaataccatcatttaaacagcgaaaattaatcagcatcaaataggctggcaatccccacaacatcgcatgtaaataatcccgtgctaaatctgacattttgctttccatttgcatatattgcagcggaatttcacagaaataaatcagcaaccctaaaggaatactcacgcctaacacaagccaaatgccttggcgaacttgatgggcaatgcgatggcgttggcctgaaccattcaaataagaaattgtaggcggcaatgccaacaataaaccttgtccaaaaagcatcaatggcatccaaattgaagcaccaatagaaatggctgccatatcagtggaactcacacgacccgccataatggtatccgctaatcccattgagttttgtgcgatttgtgctaataaaataggcaaggaaattttaatcaactttttaatatcagcgtggtattgagataaaagacgaaaattcataaatttgatatactgctaaaaatttttagaaaaggaaaaaattatgtttactggaattgtacaaggcaccgcccccatccactccattaaagaaacggctaattttagaacacaagtggtaaaattactacctgaaatgcgtaaagatctggaaattggcgcatcaatagcaaataacggtgtatgtttaactgtaactgaaatcaatggcgatctggttagctttgatctgatgcaagaaactttaaaaattacaaatctcggcacaataaaagtgggcgattatgtgaatatcgaacgtgctatgcaaatgggaacggaaattggcggacatttattatctggtcatatttattgcaccgcaaaaatttcagatattatcgctagtgaaaataaccgacaaatttggttcgagctcccaaacgcagatgtaatgaaatacattttaacgaaaggatttgttgcggtagatggtattagcctcactattggtgaagtaaaaggcacgcaattctgtgtgaatttaatccctgaaaccttgcaaagaacgttaatggggcaacgtaaagtgggcgatattgtgaatattgaaatcgatcctcaaacgcaagctattgtagatactgtagaaaattatttgcagtcaaaaaatttttagttcatttaaaaatattaagcaattgaataaagtgagaatagtcataaaacctattctcacatcatcaagtgttactgcaacgctttctcaattttttcaaataaatcttttgaaagattttctacaacgcttaggcgttctaaagcacgtttcatcagcgtttggcgttgagcatcaaagcgagaaaatcgaattaatggctcgattaaacgcgcagccacttgtggattactttcatttaaacggattaacacatccgttaagaaacgatagccagaaccgcttacgttgtgaaatgcttttaaattgtgatttgcaaaactacccactaatgaacgtaaacggtttggattattaaaattaaaacttgggtgatccattaataactgaataatttccaacacattttcatctgggcgagtggcttgtaatgcaaaccatttatccatcactaatccatcctgttgccatttttgttcaaaatcagctaataacgcatctctgcaaggtaatgcagctttagttgcaacacttaatgctgccaatgtatctgtcatattattcgcattattatagtgtttttgcactaagttgttacccaaattcgtataagccaaataagttaagcaaagattacgcattgcacgcaaggcgatgtcttgttgcgtaacttgataatcatcaagacgaatatgggtataaacacgcaagaaatctcttttaacgattctgcaatttgcgcttgcataaatgctcttgcgactgaaataccatcaggatcgatagttttgaaacct

SEQ ID NO: 454 - DNA, 3324 bp, H. influenzae
ctggtatacgaatatcggcctcggtacccacaaacatataaacgcttagtattaggcaaagaatgcgtttgcgtaatgcttatgtgattaaagctgaacgtgtagaaaaagatgcaaatggtgaaatcaccacgatcttctgtacttacgatcctgaaactttaggtaaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaattttaatcaaccaagtgcggtcaaaacaaacgtgattttgaccgcactttttatttgtatcaactatgcaatccaatatgcaacttgaacccaatttctggcaaacaaaatccctgcttgaaatgactgaatctgaatgggaagccttatgtgatggctgcggcaaatgctgttatcgcaaatatattcaagggcgaagtaaacgccaaaaactctattacacccgaattgcttgtaatcttttagatgtggaaacaggaaagtgcggtaattattcagagcgttttaacattgaaaccgattgcaccaaactcaccaaaaagaatttacctgattttcattggctgcctgatacttgcgcctatcgtttgctttatgaaggaaaaacactacctgaatggcatccgcttatttctggctctccccattctgtaaaaaatgcggatattttgattaaaaatggtatccacgaacgcgatgtgattgattggtttgaatttattattgacgaagatcacacttttaaataaagccagttgtcatcaatttcagcttagctataatccctaacaatagttatacagttgtcatgtggtgtctatgcaaatctcggattctctcaaacaaaaagcagaaaaatgcggtatcgcgctttctcactatgatattgatgggcatcttatttttgcggatgaaaagacggttttaacttttgttgagcttttgcagcctccgccaaaagcgaaaggacagtttgacgatgtactggctgcatttgaaaatgaaccgattgattatcgactcaatcgtctagatctcccaccatctgcggaatatcgttatcagctgattgatgaatctaatgctattctgttagaaaaaatactttcaaatttatccgcactttctttgcctccacttccttttggctattatcaattatctattttttctgacactgaacagtatcgcgttcgtttacttatttctcctaaaacagcttttcaaccatccgtattaaaaaataaaaaagtgtggggcgtgaatgtgcaactttacagtttacgctcagaacaaaactgggggattggcgattttggcgatttggctgctttgattgaacaaagtgcaaaacaaggggcggattatgtgggaattaatccattacatttgccatatcctgctgtgccaaattgggctagtccttatagttcatcctctcgtcgttggttgaatttcttatatttggacattcctgatttacccgaatttaagcgttgccgttcagtacaaaattggtttaagcgtgaggatattaaagcaaaaattgctgctttacgtgaaagtgattgcgtcgattattcttcaattttggctttaaaattaaccgcacttgagtccctgttttatttctttcagcgtagtcaatccgttgaaattgtgacacgtcgaaaaatctttgctgattatttaaaaagcaaaggggaacctttgttgttacagggcttatttaatgtcttggatttacaagaacacgctgaccatcaagcagaagaaaataccattggttggcttggctggcgtaaggaatggcagcatttaagtgcggcaaaaagaaaagccctattaaaaatacaccatgagcaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccacctgatccgttaggcccagtcgggcaaaattggaatttgccaccttataatccaacagtgctaaaagcacgtggctttacaccatttatcgatatgctacgtgccaatatgcaatatttcggtgtgctacgcatcgatcatgttatgggcttattccgtttgtggtggattccaaaaggaaaaaccgcggctgacggtgcttatgtgcattatccttttgatgaattaatggcgattcttgccattgaaagtgtacgcaatgaatgtttgattattggtgaagatctcggcactgtgcctgatgaagtgcggtggaaattaaacgagtttcaaattttctcttattttgtattgtattttgcccaacgaaatggcgaatttcctcgtatatctgattatcctcgaaatgcttatgccactattggtacacatgatgttccctcattacaaagtttttggcattgccgtgatttagaattatttaatcaactcggtattctgaatggggaagtgctcaagcaaaaatatgatcaacgtgttatggataaacaagccttattaaatagtttacatcgtgataattatttaccgccgcattatgaaggtgatgcactttctatggcgatgcacgattatttaaatcgaatgatccattattatttagcggaaagtaacagccgattgattggtgtgcaattagaaaatttacttagccaagaaatcagttctaatttaccgggcacctcaaatgaatacccaaactggtgcaagaaacttgctcaaccgttagcggttatttttagcaatgaagctttaaaaacgttctttgtgcaaattaaccaagggcgaaatgtttaaggagtaaatatgacaaccggcatacacaagcactattgttggtttttttttgagcgagcaagggggatctttttgcacccttggatgccccaacccgacagggaattgaattcttccttattgcccatcccctcttatgcggccccct

SEQ ID NO: 455 - DNA, 3490 bp, H. influenzae
tgtatcgattcggctcgtaccctgtgcttgattccgtagaagtgcggtggatttttttgtttttttgctcattgggttatcctattcaaaggtaaatattgttgatttgttgcttgatacatcgccgcctaaaccataaggcacatttaaaatgcagttcataattgcccatgataaatcgccgtggcttgcatcttccgaacggtccgaaacataagtaattttccctgtgccagtaatgcgttttttcacggtcataaaactactcacgatgtcattgtcaccactatcaaatttaaggcgacgtttctgaattaagttttgtgtttttaacaccatttcatttttaagatcggcgttatactctaggccctgcgccattggataaaactttctcacttcctgataaacgcccgaccccatacccgttttatcaatcacgatgcgagtcacattgtaatcatcacaaaactgcttaatgcggcttgcttgtgtttcgtaatccataccgtgaaaagtttgtttatgtaaaacgcgataatcgcccccttctactttcggcggtgcaacaatcactaatgctgcacggtcgccagtaaaagcagggtcataacctaaccacacttcacgattgccgaatggacgttgataaaatggcttataatcgtgccattcttccaaactatccacttggcaaagttgtaagtccgaaaacttgaaagcagaactgttatcatcggcaaattgacacaaaaacaattgttcaaattcttctttgctgttttctgcgattaggtcgtcaatattgaatagattgcacccactttccattgcatcataaatactcacaatctgcttccattgacggtcggcacaaagttttccgctctttaagttttcgtgagaaatatcgatttcgattttttctgatttcgcacgattgcgattaaacgccttgcctgaaaagaacgcataagcagggtgtgcaattgtggtcggcgtggaaaaataagtttggcgatacattttttgtgctgccatacctgatgccacttttcgcatcacatcaaatttaggcacccaaaacacttcatcgaaatacaaattgccgtggtaggattgagccgtagcggagttcgtgccaaggaaaatcaattctgccccatttggcaatttgatggtttcgccttttaaatctacatctgccgtttgcttggcgtaattcacaatgtacgagcgaaactgtaaggcttgttttttactggctgataagaaaatctgattgtgccccgtcgtcaaagcatcaataaaggcttcatgggcaaaatagtaagtcgccccgatttgtcggcttttcaaaatatttctgatgcggtgttctttcgccttgtgccaaatacgttgataattaaacatcccatcaagaaagccatttatcagcaattcctcttgttcctgatcaatggcattgggttcggctttcttccgttcgcccttgttgcggttcgccagtttcgggtttaaatctacttcattaccgtcaccaaaagaatactttttcactctcgccattctttccatttggcgaccgagcaaatcaatttctttgtaatctgaaccgctcttttcttctttcgcaatcagcaaattcaatcttgtctctaatgccaattcaacccgaccaacaggcgcaatatcgtcccatttttctctgtctttccaactggcaattgttgaggcaggagtatttaactggcgtgaaatttcagcgattttataaccactgaaatacatctgctgtgctttacgtttgatttccactgtcacttcgggggaaggttgattaataacttgttcgtccattcctaatcctttctatttacaaccgcataatagaaagggggcgaatgttagtctttccgcttgctctgtgaatcggcatacaacaaaagcaactcatagaccaccaaaattaaacctttcagaatagcgacaatcattgaatcaaaccaaccaaaggataagcaatggcaaaaaaatctaaatgggtggttgtggcgacagaaggcgcaaccacagacggacgcactattcagcgcaactggatttcagaaatggcggcaaattatgacccgaaaaaatacggtgcacgcgttaatcttgaacacattaaatggcgttatatgtggaacgatgatccgcactcaaaatgctatggtgatgtgattggtttaaaaacggaagaaaatgctgaaggtaaattgcaattactggctcaaatcgacccaacggacgatttaatcaaactcaataaagaccgtcagaaaatctacacctctattgagtgcgatccaaattttgctgacacaggtgaagcctatttagtcggtttggctgtaacggacaatcctgcaagtcttggcacagaaatgttggtattttctgccggtgcaagcgcaaatcctctcaacaaccgcaaagaaaaagccgataacattttcactgcagccgttgaaactgaattggaatttgtggaagaaacacaaagcatctttgaaaaaatcaaaggcttgtttgcgaaaaaagaaaaatcagacgatgaacgcttttctgatcaaacacaagccattgagcttttagccgagcaaaccaaagaaaccttggaaaaattaaccgcactttctgacgatttagccaaacaaaaagccgaaatcgaagaaatgaaagcaagtaatgcagaaatccaagcaacgttcgcagaactccaaaagcctgttgaacccgaaaatcctcgccctttagtttacggtgaacaacctgaaactgacggccgcttcttttaatttatcttaggaaaaaaccaatgaataaatttaccaaacaaaaatttaatacttaccttgctggtgttgcacaagataacggcgaagatgttgcttttatcgcaaatggtggtcagtttaccgttgagccaactattcaacaaaaattagaaaatgctgtgcttgaaagttctgatttcttgaaacgcatcaatgtagtgatggtgcaagaaatgaaaggttctgcattgcgtttaggtgtgctttcaccagtggcaagtcgcaccgacaccaacaccaaagcacgtgaaaccactgatattcacagcttgcaagaaaacacctattcttgcgaacaaaccaactttgacacacatttaaattatccaaccttagacagttgggcgaaattccctgattttgccgcacgtgtgggcaaactcaaagcagaacgcattgcattagaccgtatcatgatcggttggaatggcacaagtgcagcaacaaccacaaaccgtacctcaaatccattattgcaagatgtgaataagggttggttagtccaaatcgaagataaagccaaagcccgtgtgttaaaagaaattgaagaaagcagtggcaaaatcgaaatcggcgcaggtaaaacctataaaaatcttgatgccctt

SEQ ID NO: 456 - DNA, 4088 bp, H. influenzae
  misc_feature (2541)..(2542): n = a, c, g, or t
agtaggcttcgggctacctggttaaggggcgcaataacccttggccatccccccaaaaagatgcaaaacaacatggcgagagacggaattaacaaccaaaaatcaaagcctaaggcaaaacaacaaaggaggccaagcactgcacccaagataaatcccattgctgcagccaacataaattcacttacagataacccgccatacacactcgattcacgatttaatcgagtaggaagaaaggggattgtttgttctttatcgcttgacatcttgacctcacagagataattaaaacagaccgatagccaatttcaccaaccagaggctgaagaaaattaaaatgaaaccaagaataagagcgataataaatgggccccatccttttttgtcattttcgtcagtcgctgcgttataggttttaattaatgccttaaccactgtcatgattgaccatgctgcaaataaaattgcacacaaggttgccaatgatttagcaacaagatagatgatttccatcgggtctttggtattgctatctacgcctgggattttaaaatcagggattttagaggcattgataccattaccaccgcctgtagcaaacgcattttcaacggataaccaaagtaaagttactaccgcaagaaaacgacttgaaacattctgaaagaaggatttaatcaacttcatgagatgtccttatggtttgttaaataaaaaagctgacaacacatataattaatgctgcgccccatagaatcagtttaaagaatgaccaaatatcaccgtcgttcaccatgcctttgtagccatgattagttgcccacatatacgcaagcagtaatacgacaaccaaaataatggccagcatgattttcagttttagcgggtctaaaccacttacagtataaaaactgtctaatggtgaaacagaagggaaattagcgttactcatctgctattgactccgaagattgagataatcttcttttaagttacgaatagctttaggatttctagggattgcccgggaagggttaatatattgcttaatccctgcctgtaccgtagcaatatcttgatgtgctgaagcgtaatcaaaatattcacgacttttcgcagaaacctttgcacttgcagctgctcgctgtaatgagagttttgctgcatccaactgtttaattgcttgcgctaaatgctcttgctctgttgcttgagcacttatagcgccaaacaataaccctattgctagagataaactgaaaatatttttagtcaccggagactccttacttgaaacagattccaagcaaagagtgccaaagaagagagggaaatttaatgagaaactctttttaaattcaaaacagtttttagtgataaaaaagggcgcttattcttggaaaaataagcacccataatgacaacatagaggaatattaaaggtattttttaaagctcgctgccgttacacagatggatagtccaaatagaaatgcagctggcaccaaaattatattcgggtaaatagaaattgggatagaaagatacaatacccatgccgacaacataatcgggccaattaatcgacgtgcatgatgataaagaaaactagactctctgcccgcaccaaatttacgacggtcacgcatcattaacccttcagtaaagcccgcaaatgcggctaacaaaaagagtggggaagtaaaaacaatcactacaagtcgaataacaaaggtgataaaaacataaatcactgactcaatatacgctcgcccataatgatacacccacaaacctacgccactatgctcacgagggttggctaaccaatcttttacacctgttttcacaaaaagccattcatgtaatgacaaaataagaccttcagccagctcttttggagaatgatagaaaagacctctcgttagactatcagaaagccatccaagctcagttagcatcattttttgactgtgtaaatgaccttcttcaggccataaaaatgcaatacctaaccattcaagaataatgctcaaaatcagggaacccaataaggcggctaataccgcattaatgtagtaaaaaagaccctttttcttttttttgacttgttgttctgccattactgtaatgttcccgctggagataatttacagtgaaagaaaagataaccttttacttcaccgtctaaaaaaatttgaattgcctggatgccattttcagatttttttacatcattagccgtccaaagtgagatgcctttatttgcatactttttcgcaaattcatgtgtggtataacgctgattattccaatcttccaaataaggtaaaaagtaattaagtaattcatcagcgttttccagcccacaagaacagctagtgactgaattgaaatctacgctcatatccggaatatcaagcaagttcatatccggctgattaattatctgtgtcatcaaaatcatcctcatctgtatcatcattctgatcaatatcttcatcttccatatcttcagcaactggagcttcaacatcnnccgaaaagcatttcttctcctgcgtgtgaaggcgctcgatttaatgacattgactgaaaagcggttgctatatcttgacttggcgcataatcagaaaatgcagattgccaccaatttggagaaatatggtagtttttgcgcatataagccgtcaattcttgaagtgattccggcatcacatcatctttatcaaccgcaggtaaaggcattcttaatttataaagcgtactcccttcaagaagagcaaatgcctgtccttttggtaaatttgtaatatgtgctggcgatagcattggcaccattttttcagaaatacgttcaccagtattagaagtaaacgccttgccatcatccggattgctgttatctgtcgtacttgatgtcaccatgctttgataaattgtgacatcgttgagctgacgcgttaaaaactctgcagtggccggctcttttacccggaacattaaaagtgtattgaagttacctgttgtttgtcccgtttttgccttacttccaatacgagcttcaatatctgaaagtgtttgagtataggctgttacctgcattcccgcaccacgacctttattgatcagcgggataaattcatcccccatcaattcattgaactcatcgcaatgaaggttgattttaggcggtttgcttttagttttaaatgcatctggcaacccctcatctacgccaaatttataaatatgaccagccattgataccaaatcagcaaacatactattacccacagctgcagctacggtcgcatcggataatgcatctaatccaacgtaaacaatccctcttttacgaataatagattcccaatcaaagatagggcgctcatcatgaatatcagtgtaatcaggcgagagaagctctgcagttttacctgtagtgagtttttcaagtaacggtaaaagcgatgccacaattttatcaaaataggttttatcgtaacgtaccgcacttgataacccttcaagtaccgggtcaaaaatcttattctctaaaatatattggttaataacagcaatcagcggtctatctttcatcgagaacggtaaattttttacatctaagttagccgcaaccgaagccaacgttggccatattttcttatctacggcatcaaaatgaagtttggcgtaatctaagaaaagtgcatcaatattttgcacaaaacgcgagatttgcacatagtccgggcgttttcccatttcaaccaatgcacgggagacaatattcacaaaacgccacgcaaactctttaaatgctgcactatttcccgcaccacttaattgcccagaaatacgtcctgccacttcagaaattcgaccgaagcgaccaactgggttatatcgagcagaaatttccggatgccctaaatggaatacataaaattcattttcacgccccgcacgttttgcttctgcatacattcgttttaacatatccgggtcgccttcggatcaaaaaagacaaccacttcacgttctccaggtgttttacctggggtaccgaaggcccgaattcc

SEQ ID NO: 457 - DNA, 4277 bp, H. influenzae
  misc_feature (2280)..(2280): n = a, c, g, or t
  misc_feature (2283)..(2283): n = a, c, g, or t
  misc_feature (2288)..(2288): n = a, c, g, or t
acgaatatcggactcggtacccttttattcttaggtaaacgtaatatatcccagatcaaccgaaaaacagattttggtaaattcttggtttggaatatataccaatttttttatatacaaacttcggcggaattaaaatatcttgtgtgtaatttttcttttcttcgagaataaaagtaattgggttattcagtggtgataaagggaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctgtttgatgatgaaatgcgtaaggattccctttttcttgataaaaatcaatgcctgtcaaataaagatctttataacccattgcagttgccactgcacacatatagacgcctgatgtaatcctcttattctcatatagttcgtgatattgtaaatgagcatcaaaagctcgtagtttttttaaatagctatgaccaagatcgatttgtggtagtaatttttctaaacgctggattttctttaattctgaatcccctaaatttagaaaagatgataaaataatatcagcatattcatattcattatttttaattaattgcataaacgtatagtattgttcaaaaattacagaacaattaaaaaataccttttttattttcttaccaagaaaataatgatcctcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattggacatattgtaccgttcattgaataaaatataacttatctttaatactaaaaaatagtagctattatacaggctttctgtgctttttactataacgccacaacaaatctaatgaaagtcagatttgattagactataatacttccttaattttttatatagaaagaggatctactatgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggtttcgggtatgcactgtaatatgtcgttaagtaaagacgggaggaatattttcccaggcgaataaaaagcagggcctttctgaaaccgccctttactacatcggcggtatcattaagcccgctaaagccttaaatgcgttcactaatccaaagtactatttcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaancanaaatnccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaatgtcattgacgtaatcatttttaaaagtgcggtagaatttaccgcacttttcgtttgaaattgtttataacgagactcgggtaaaaatgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataaggtcaaataattaactattagaaataaagctggtatagtttctaaatttattttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcgggctgaatttatcttaaaccaagctgatatttataatgaaaaaagtgcggtaagtttttaagaatatttctggttgaggaacttgagcacaaggttatcacgggatttggactgtgggtaaaggctctgctaacttgccgctatgtgcaccc

SEQ ID NO: 458 - DNA, 3641 bp, H. influenzae
tggtggcattgcgacgtaaacgtgaccgtcttgtaccaatttcggaaaatgacgtaagaacagggcgcagagtagggtggcaatatgcagaccatcggagtcagcatccgcgagaatacagactttaccatagcgaagttgtgataaatcattgctgtcaggatcgatccctagagccacggcgatatcgtgaatttcggttgaacctaatacttgatcaggggaaacttcccatgtgtttaagattttcccacgtaacggcaaaatcgcttgatattcgcgatcacgtgcttgttttgctgagccgccagcagagtcgccctccactaaaaataattccgttttttctaaatcctgtgagccacaatcagctaattttcctggtaatgctgggccactaacgagtttttttcgcacgacttttttggcggcgcgtaatcggcgttgtgcagaactaatggcaatttctgctaatttttcagcatcttgtacattttgatttagccataggctgaacgcatcttttaaaacaccgctgacaaacaccgcactttggcgtgatgataagcgttcctttgtttgccctgcgaattgcgcatcctgcattttaagggaaagaatgtaagaacaacgatcccaaatatcatcggcggtaagttttaccccgcgtggtaatagatttctaaattcgcaaaattctcgaatggcatctaataaaccttgacgtagaccattaacatgcgttccgccttgaattgttggaattaagtttacgtagctttcgccaatcagttcaccaccttctggcaaccaaagtaatgcccagctaaccgcttcatttgttcctttaaattcgccaacaaatggtttttccggaagggtttcaaagccatttactgcttcgataaggtaatcggaaagcccatcttcatataaccaaatgtcttgagtattgtttactttatcaatgaatttgatttcaagccctgagcagagtaccgctttcgctcttaataaatggcgtaggcggctaacggaaaattttgcgctgtcaaaatattttggattcggtttgaagtgaacggttgttcccgttgtgcgtctaccacaagtcccgataatttccaattcttctactttactgccgttttcaaaggcaattttatagatttcgccattgcgtttgacttgaatatccacgcgttcagaaagcgcatttaccacagaaatccccacaccgtgtaaacctcccgcaaattcataatttttattggagaatttaccaccagcatgcagtttagtcaggattacttctacgccagaaacgccttccgtaggatgagtatccacaggcataccgcgaccattgtccgttacttcaatggattgatcagggtgtaaaattacttcaatttttgaggcaaaaccggcaagggcttcatctacgctgttatcaataacttcttgtgctaaatgattagggcgagtagtgtcagtgtacattcccgggcgaatttgcactggttcgagatctttaagaacggtaatttcttgagctgaataattggttgtcatggtgaggttattcgttaattttttaaatttgagaaaattctatcaaaaagtgcggtgatattcgaccgcacttttaatcgtataaactaggcgtcttttcatcggggcgcgttttaaaacggcgatgtagccacatatattgtgatatccccttcatgatttccttttctacgatttgattcattcgcgcagcaatcgccgtttcatcttgtaaatccgtaaaatcaacaggcgctgaaatactcacggtatagcctgaaccatctttattgcgtaatggcgcaaatggaatcactttgctgttttgtgaagatttcaataaataataactaccagtggttgtgcaagcatcgggtaccgcaaaaaagggaacaaaaacggcattttttctgccgtaatcgtgatcaggcgcataccaaatggtttcttcgtggcgtaaagctttgatcattccgcgtaaatctttacgatcaagcatatctttattagagcgtaaacgaccttgcgtttgtagccaatcaagcaaaggattatcatttggacgataaacgccaatgccgggatgatgcaaaccaagaatgcgcgcgccaagttctagcgttaagaaatgaacaccaacgagaacaattccatctttttgattttcttttagataatgtaagccttcaacttttgaccattttttgatacgtgaatccgaccaaaaccaagccatgccagtttcgataattgccatgcctacagagcggagattttcttgcaaaatcgcctcacggtcgttttcagacatatcaggaaaacaaagttcaagattacgacgtgcaatggctgctcgacgtttacccacttttaaatgtgaaaacagccaaccgagaccatgaccaatatggcgcaaaataggatagggaagacataaaatacttcgccaaattgccacgcctaaccaaaaaagccagtattttggggctaaaaagtgcggttgaaattgagggagtttttcgtttttcattgttctttccacgtaagttaggggcgtagtttatcgtaaatttgagttgtggtaaaattgccacaattttggttattcaaatagagagattttaaaatggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccagtggaacttgaaaatgcggggtaccgagtctgatattcggtaaca

SEQ ID NO: 459 - DNA, 4226 bp, H. influenzae
  misc_feature (4141)..(4141): n = a, c, g, or t
cgtattgtaaccgcatcttattgcgaaggtcaggcgatcctattacgcccactcgtttgagcggggtttaacgcagacttggatggagaccaaatggcggatcatgttccattaacctttgtagcgcacttacaagcttgagcgttggatgatgtcctccaatagctagctttctccactaaacggtgatcctattattgatccatcccaagacgagatagtaggtctttactatatgacccgcgaaaaagtggacggacgaggcgacagtatgttattgtacgatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaggcatgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctgggtcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaataattaattccctgtatgagaaaacccgaatgaaagttcgggttttttatttttatgaaaatgggtagaggttttatgccagaacaacaagtatgtttcttcatagaaattcacaaaaatttgagacttttagaaaagtctgttgttgatagttatgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaataggcatttaaataactaaggcagggattccctgccttattacatattacatctatttgnctttttctatttcatcacttttacacatttaccgtacccgctttaatcgccattcacattaaattctacaacttgttcctaatac

SEQ ID NO: 460 - DNA, 3919 bp, H. influenzae
  misc_feature (3853)..(3853): n = a, c, g, or t
  misc_feature (3882)..(3882): n = a, c, g, or t
caccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaattataaggtagggcagaatggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattctaaaggactgttttcatagacgaattagtgtaaaaaggcgtgtacgatacgcctcttacttgataaataagaaatcattgtagctgtagtttttctttcgaagagaagaaagtggatttatagaggaaagatgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacattaaaccgctctttaacggatttaggtgcgttgttgcacttggtcgatcccaccttgccgattggtggatttaaccattccaatggcttggaaaccttcgtcagcaacgtgtggtagaaagcaaagcgaccctagaagaatatgtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcgtaagtgcggttattttttattgagattttacttgtaggggcaaatcacatttgcccttgaacattcgttgatatataggggcaaatgtaacttgcccctacacccatgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttnccctgatgtggaaatcgtgttcatgaatncaggtggcgggtaccgaggccgatattcgtataccag

SEQ ID NO: 461 - DNA, 4867 bp, H. influenzae
  misc_feature (4853)..(4856): n = a, c, g, or t
  misc_feature (4858)..(4859): n = a, c, g, or t
cttcataatgcaactgttccagccaaaaaaagcatttttacatcattcttcccatcacaaaaagcaatacagtcttttaactgatactcgcgtgattcgagtaaatgttttaatgcatccccttttgaaacattcttattcattacttccaaacaagctaatgctgaataaacaattgtcgttacgtcaccaaacttatctcgtaaataagtttctactgcaactaaatcctctggagttttaccaataaaaaagactttttctgtccccacgtccatgatgtttagaaaaatcgacaacgttataatcgaatccagattctttatggaactgacgcattgcaggaatatctttattagtaaaccaaccttcatcttgatagctattcatgcatactttggaagtatcaaatggcgttttgtaaagctcaagaactaattcttcaggcaaactattgctataaagcaaattaccctgtaaatcccgtacacgagcaccgtttgatgtaatcataaccgcacgttccgcaccaatttttccaagaatggatgacacatcggtatgattgcgtcctgttgccaaaataatatctacgcctttttgctctaatgctctcagcgtatcaatggtaagatcacccactaaatgttcaggtgttaaaagcgtgccatctaaatcagacaccattgctcgaaaaggtaaattcataaaaacctcaaaaaataaactatgtttatcatatcactaaatatacaaatggtacttgctgaagatcaatatattaaaaactgcaataaaaataaccgcacttttattaagtatagatagacacattcctcttcatcaaaaataaactaaaacatattttcgtttaaattcatctactattagaaatcaaacaaataacaataaagagttagattatttttattaaattctaataatactaaaaatctcgcaataaaattctacatactggcattaccagttgaaaaacgacaacaaatttcattttacctctcttataatgcaactgttcgaacaacaagcagtatctcgaatgatgtatgtttattccccaatgtatagtcaaaacacaaggagattattatggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggcataaggagaacgtatgagaatagtgattgcattaggcggtaatgcattattacgacgcggagaaccaatgacagccgaaaatcaacgacaaaatgttcgcattgcttgtgagcaaattgctaagatttggccaaataatgaattagtgatagcacacggtaatggcccacaagtgggtttgctcgccttacaaggtgctgcctatactgatgtgccaacctatcctttagatgtattgggagcagaaacagctggaatgattggttatatgattcaacaagaactcggtaatttagttccatttgaagtgccatttgcaacgttattatctcaagtagaagttgatatcaacgacccagctttcaaaaatccaactaagccaataggtcctgtttatacaaaagaagaagctgaacgtttggcaaaagaaaaaaattggtctatcgcacaagatggtgataaatatcgtcgcgttgtgccaagcccattaccaaaacgtatttttgaaattcgtccggtcaaatggttgcttgaaaaaggcagtatcgtaatttgtgcggggggcggtggcattccaacctattatgatgaacaccataatttacaaggtgttgaagccgttatcgacaaagatttatgttcagctttacttgcagaaaatcttgacgctgatttattcatcatcgcaactgatgtttccgcaactttcgtagattggggtaaacctaatcaaaaagcaatttcagttgcctcacctgaagccatttcagaacttggtttcgcttcaggttccatggggccgaaagtacaagccgcgatcaactttgcgaaacaaacaggaaaagatgcagtaataggatctttatctgatattgtggacattgtgaaaggcaaagctggtactcgtattacgaaaaaagctgaaggcatatcctattatgcttaaataataaaggaactttgggaagccattctcaaggtaaaaagtgcggttggtttaaccaatgttttaccaaccgcactttaaacgttaaacataaggaactcgctatggatgcgtccaaaaagaagaaaacgtttaatttcccatcagcgtttacaattttatttgcaatcttaattctcgctgttggattaactggggttattccatccggttcatattcaaaattaacatataactctactgataatgtttttgtcgtcaaagcttatggcgttgatgataaaacttatcccgccacaacagacactcttgataatctcaatatcaaaattaaactctccaacttcaccgaaggcgtgatcaaaaaaccaatcgctattcctggcacttatcaacgtgtagaacaacaccataaaggcattgaagatatcaccaaaagtatggtagaaggtaccattgaagccgttgatgttatggtctttatctttgtattaggtggtatgattggtgtcattaaccgtactggttcttttaatgctggtttgatggctctcgtgaagaaaaccaaaggcaatgagttttttattgtattctgcgtatccgtcttaatggtgttaggcggcacaacctgtggtatcgaagaagaagcagtggcattttacccgattctggtgccagtattcttggctctgggatatgatgcgatagtctgcgtaggggctatattccttgctgcatctatgggaactgcattctctacaattaacccattctccgttgttatcgcatcaaatgcggctggtattcaatttactgaaggtattggtttccgtgctctaggtttagttttaggggcaacttgcgtaatcgcatatctttattggtactgtaaaaaaatcaaagctgacccaagcttttcttatacttacgacgatcgcgaagaattccgtcaacgttatatgaaaaactttgatccaaacacaactatcccattctcagctcgtcgcaaattaatcttaacgcttttctgcatctcattccctattatgatttggggtgtaatggttggcggatggtggttccctcaaaggctgcatctttccttgccattactatcatcattatgtttattagtggcttgtctgaaaaagatgttgtggaatctttcactgaaggtgcatcagaattagtaggcgtatccttaatcatcggtcttgctcgtggcgtgaacttagtgctcgaacaaggtatgatttctgacactatccttgattatatgtctaatgtggttagtggtatgccgggtagcgtatttatcttaggccaattagtcgtatttattttcctaggtttaatagtgccgtcttcttctggcttagccgtactttcaatgccaattatggcgccacttgctgactcagtgggtattccacgcgatatcgtggtttcagcttacaactggggacaatatgcaatgctattcttggcaccgacaggattagttttggtgacactccaaatgttgcatattccatttgatagatgggttaaattcgtcatgccaatgattggatgcttattgctaattggttccattttattggtagtacaagtatctttatatagtgtttaattagtcaaaaatacctatcttaattctaggcttggcattaaaaccttaaaatcagaagttactctaaaaacggtcaaatcaacaactgaattgcctttataaaatcatcataatgattgctcctaaaataaaaagaagcacgcatagaatgatgcgacttgtnnnngnngggggggg

SEQ ID NO: 462 - DNA, 5085 bp, H. influenzae
  misc_feature (3500)..(3500): n = a, c, g, or t
  misc_feature (3544)..(3544): n = a, c, g, or t
  misc_feature (4866)..(4866): n = a, c, g, or t
  misc_feature (4873)..(4873): n = a, c, g, or t
  misc_feature (4890)..(4890): n = a, c, g, or t
tggtaccgtatatcggactcggtaccctgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaaaatgtgattcgataacaaagaacggtgctgaaatagcaccgtttttgttattctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttcccgcgttcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaatcgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagctaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcagggaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagtaaacgacctgtacgagaacgaccgccctcaataaaatttcgacggaatagcctcgatggaatagttctgataaatattcgcgaaaaatggcagaatatagtcgatttcccttaaaagtgcggcgaataaagaatgccccccaactacgaaccattctacctataggccagaaatntaagttaatccctgccgcgatatgtggcggaacaagaccttgantgataaagcacataagaaagcaataagtaatcaatatgactacggtggcaaggcacataaacaatttcatgaccttctaacgctaatttacggacacgattcgaattttgtacatcaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccaggagaacgtccccaaagaacagaaacaggaataagttgcacatctaaactttcagaagtgcggtgtaattcaagatatttattgaaaatggtagtggtttcgtcttttgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattangtttcanatctgcaaatgccgcanaagaacatttgaaagcactttcacgtaaaggtgcaatcgaaatcattcccggcgcatttcgtggtattcgtattttagacatagttcaatgatgaatttgacggttaccgcttgtaaggcccgtggctgctggatatccgattcttgcagagagcctattgaaggaactattcggtgaagccgatatgtttaaac

SEQ ID NO: 463 - DNA, 4313 bp, H. influenzae
  misc_feature (4038)..(4038): n = a, c, g, or t
ctgtatacgattcggactcggtacccttttactcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaatttttagaatataaaaatcttttttataaaacactttaatttaacggtgatcgtttaaaacaatcaccgttattggtatcagcagagccagaaaggctaattaccatatttggtttaggcgtataacggactccagctgcaacggcagattgtcctcgataagtccctgcagctatgccagtaatttggcgggttatgcctcttattttattccccactgaaaccgaacccgcagtgcctttccaagttgaaactaattcatttttagctgtttcataagatttagttgcgttgtcaatcttagcttgatttggattagctgcggttttcaacttttccatattgctttttaacctagcaacttcctctttttttttcggcaaatcgtaaagaatattacgtaattctgccaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgattgcatcatattctgtaccataaagttggcgtgcgtaacccataatatccataatcgtaatggtggatgctaatgccgttcctttaaataccaaaataatttcgttactgtaagaaggcaacgcacgttttaaggcataaggaattaagattttgagtgtctgtaatcggcttaaccctaacgctgcgcaactttcccattgtcctttaggaatggcttttactgcaccgtgaaataattgggtggaataagctgcgctgtttagtgctaaagctaatacggcacagaaccacgcattggataagacataccataatgggctgtcaataatccattgaaattggcctggccctgcataaattaaaaagaactgtactaacagtggcgtgccagtgaataaagtaaggtataaattgaccgcactttttatccatttgttttccattgaaagtaaaaaagtaagaaataaggctaaaaagaaagcaatcagtaaggatacgactgtgagtagtaaactcgttggaatcccttgtacgatcacgcttaaatattcttgaaacattatttcatgcccctttcaaaacgagtaaaacgcagctctaattttcgaataccaacttggctaattaatgttaccgctaaataaattaacgcagcaataccgtaccaagtaaagggttgatgagtattggtattcatcagatccgcttggtgtatcaaatcgtccacaccaattaatgaaaccaatgccgtatcttttagcaatacaagccattggttgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaatgagagaaagcgcaaacacaccacagccaaatgccccaaattcaatgtattctcctgtcagtatttcgactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgtcatccatttatcatagattttttggtattcgccatttgctttaattgcagctaaacctttgtttaattgtgcagccaaatctttgtttgatttgtgcattgcaatacctaaaccattaccaaaatattttttattggttactttttcgcctataaattgaatttctggctctttggaaatcatatcggaaagcactgcggtatcgcccaaaataatgtcaatccgaccgctctttaagtctaaaatggcattttgtaaacttgcataggattttggactatattgcttggtttctgctacggtatattgttggaatgttgtaccattttgaacacctatatttttgcactttctaaggttgctttgcctttaagagcaacatagcttgcagagctatcgtaatacgcatcaggagaatacacttgttttgcacgagcatcgggtatacaatttgcggaaatgctgcatcaaacgttttgcctttaaactgggaattaatgaatcaaaggtttcgctcttgaatttacaggttgcttgaatttcttgacaaattgcatttgctacatccacatcaaaaccaataatttcgcctttttcatttgtggtttcaaatggtggatagctaggttccattgcaaaagtgagttcttgtgcgcttacagcaatagatgatcccaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggttacaatcacttgcgtaatgccagtttcttgtaattctttaataatatctacaacttgcgctgtaatttctggatctagcgcagccgttggttcatcaaataatagaacttgtggcttcatcatcagggcgcgcgctattgcaacacgttgttgctgaccgcctgataaatgcaatggaaagcgatcggcaagttgttctaaacgtaaacgttttaacaattccattgcatcagttttcgcttcactttcactcacaccacgcactttcattggtgcttcaattaggttttcaattaccgttaagtgcggccaaagatgatattgttgaaaaaccattcctacatcttgacgtaattgtcggattgctttgggatttgccattgcattggataaattaaaatcattatttgcaatacttaattcaccagactttggcacttctaacaaatttaatgtgcgaattaatgtacttttgcctgcaccacttgggcctagcaacacaacggtatcgccctcttccgcttcaaggttaatatcaaataacgtttgtgatgaaccgtaaaagaaattgagatttttaacacgaatagccatttttcttctctatgctttataagatgaaaaaatattacatttttatgcataattatgcaagtgctattaataaaaaatcccaataaatttgggattttaaaaactcgattgaaatcaaccgcactttaggcttgttttgccatttcaaactcaattaacatcattaaaatatgaataactttgatatggatttcttgaatacgatctgcctaacgaatatggngtacactaatttcaacatccgctaatcctgccatttttacgccatctttgcctgtgatcgcaatgactatcatgccttctgtttttgccgcttcatgacgtttaaaatatttttcgaattgcctgaaatgcataaaccgattacacatcgactttttgccccaccgcttcatcatagcgagaagagacatatgcatagccgatatcatttactacccggcttaaatggcttgcatcgggaatcgcaatagcggggttacccggccgattttcccg

SEQ ID NO: 464 - DNA, 4711 bp, H. influenzae
atgatttcatctaaaatggcatacaagtttctttgaatggcattgaaacagcacaaccacggatgcctaatgcgcgaacgcctttgatggcgtgctcaatatcttgcgtggtgaatgctttataaatgaaatttaaccctagcttgtcgtacaaataattgtgaaaggtagtaccgaaattactcggacgacctgataaagacatgcagagttgggtatctttgttgatcatggtgtctccttatatatttaaattcattccatcatcaatgccgataaaatattggttcatatcgaaagcaggttttgctgctttatcttgacttacaattcgagctggcacgccagccgctgtggcatattcaggaacggggttaagcacaacagagtttgccccaattttggcgtatttacccacttcaatattaccgagaatttttgcacccgccccaatcataacaccctcgcgtactttgggatgacgatcgcctgattcttttcccgtaccgccaagtgttaccccttgcaaaattgaaacatcattttcgattacagatgtttcacccacaacaatacctgttgcatggtcgaacatgattccgtggccaattttcgccgctgggtgaatatctacatcgaaagctactgaaatttggttttgtaaataaagggcaagggatttacgattttgattccataaataatgggtaattcgatagctttgaattgcgtggaaaccttttaaataaagcaatggagtggaccacaattctacagcgggatctcggtggcggacagcttggatatcgcaagcagcgcaatcaataatcgaaggattagattgataggcttcctcaataatttcacggagagaaatagctggcataataggattggctaatttgttagccaataaataacttagcgcaccacccagattttgatgctttaaaattgtagagtgaaaaaaactagcaagcataggttcgttttcagcaagttctttggcttcttggcgaatatgttgccacacatctaatgtcataatttctccttttattttattcgcctttacatgctcgccccaaaaggctgattgctacatcttgtggcgtttttgccacaaaacagcatttgataaatttgttctgtaatcggcatttccacaccttgtctttgtgcaagcaaataggcttcttttgtattataaaaaccttctacgacttgcccgatattttccatagccatttgggcatctaatcctttacctagcattaatccaaaacgtcgattgcgcgattgattatcggtgcaagttagcactaaatcgcccaatccagacattcccataaatgtattggtatttgcaccgagcgagatacctaagcgggtaatttctgcaatacctcgagtaatcagtgctgtgcgagcatttgcgccaaatcccataccgtctgaaatacccgcaccaattgcgatcacatttttaattgcaccaccaagttgaacgccagtcatatccgaatttatataaactcggaaacctttactacaatgaatacgagactgaaattcccgcgcgaattgctcgttattggcagcaagcgtaatagctgatggtagaccttgcgctaattcttttgcaaaagttgggccagaaagtacagctagtggatattgcgttccgagttgttcttcaactacggtttgtagtaaacgccctgtgttacgctccagaccttttgttgcccaaattaatcggtgatgggcttttaagtgcggtttaatttttataagaatttcaccgaaagcatggcttggcaccacgattaaaatatcttgagaatattccattgcttgtgcaagattactttctaaatgaagatcctcaggaaagatgacatccggcaaaaaacgataattttgtcgttctgtctgcatttgtgcgatatggacgggattgtgcccccataagtgagtgggagaaccattgcgagaaaaggtaattgccagcgcagttccataagatcccgcacctagcacagtgattggtgtttgcgaagttatcatatctacaatttatctagtaaaagaggaaataagtatagatatctttcgggtaacctatcaaccacaggaaaatattacttattcatttggcggaatttaaacggcacgatggatatgccattttttcccattttgtagttgataaaattgagggtagttaaaattatgttgaacgatattgtaaggatttttatcgccttcctgtttggcgttttgataaagttgattaatctcccgcactttttcatctttttcaccatcgcagtggcgatagatttcgagatgattagattcatctaaaatataaacattgaagctgtgatcagaattatcttcaaaaaagaattgtaggaatccttcacttgcgaaggcatccatttctggtggatagcgacgactttcttggtttgtctcgccatcttcaattggtgtttgtaaaacttcgtcaaaatccaccgcactttcagcgtcattacagaccgattcatttccgatttcttgtaagctgatgccgcgatcttcaaaaaataattgccagtttttacccgctacgcgtaaacgtgacgtttggcaaggttgttgaatatcgccgacttggatgctaacgcatcgattgactaatcccatcactaattgacgtaaatcttggcgataacgttcactataacaatagacttggatggaatctgggcgattaacgccacgataaattttgttagaaagcacttttagtgcaagcaaaatggcattttgcccttcaaaatggagcgttcggatttcgttccacacgttacgataagtaaaatcaatactgcccacaaggctttgctcaagcgatccaaaactaaataaatctcgcgatgaaatacccgttaatacttcttctactttggatgttggatcggtcgtgagatttatggcaataaacaagctacgaatttcacattgattcaataaatcgctatttttaggttgtttggcgatggtgcttggaaaagactgacgtaagttagtgacaaagcgttgcaatgtgcttaaagtcacattcttgctaaaaattgacaattcggttttttctgtgagtaaatgattgaaataagcccaagaaactaatttattcaggctttctccgtattcgatcacccgttctttggagaacataatatggtgtattggttgattgataaggtaccaactatctttaaaatgtttattgccacgaacttccacaaaagtcaggtgtgcttctgataaattgtgagatatctgtgtgttgagtaaggacactttgccgggaagttcttcaaaagcagtataaagtttacgagaaagaatgttgatatcttgtggcacgacgctcgagtgaatatgatgctttcgagcaaattccactaaattacgataactcaacattaaaaatttcattatgttatcgtggttttcttttactgccttaattttccaaaatggacgcttattgagatgttttaccgtttctgcagaccatccccattcttgcgcaaggatttccatataacgaatacgccaattattggcttggtaacgtgcaaaatcttccgttgctttcacatagaaacaacggtgcacaaaatccaaacgtttaaattcagaaagtgcggttaaatattgggttacttttgcaagaatggcaatgtaaggatcaaaatggtgatcaggattggtattgcctgaaagtaaatctcgcttaaaagtgcgggcaattaagcaagtgtttgggtattccttggaataggcttccaacaacaaaattttgagcacagatttataaggtgaatcaatccctttataaagatgccataaactggcccccgaaaatatcgtttgcagaaaattgtcctaaaccgcccgaaatcacccaatcatttggatctattttcccttcagtaattaaacgcgcccacctgtttttcatagtcttttccattttccacccataaatgcaaccaaagtagaagtttaccagccaagcgtacggcggagcgatagaactcatcaagcaataacatatattgcgcagagccgctattttcaatagtcagtgggtcagcataatgttcattgcggaaacgttgttgatccatcaaataaaaattaatttccacattaaattgcattgcccattcactaatccgcttggctttttgagtaagaagtgtatattcatctggactcaagccatcacggacacaaatccaagtatcaagatctgaagaagaggtttgacttattgagccaaagctacccattacataaacgcctagaattggtggtaaaacttcgtgaaaatttaccgcacttttgagtgttgatggcttatgatcggcatagtgaatactgtattcattggtgagccattttttttgataatcagaagcaaggaaattcgcaatgccagagggggcgtgaataacatagccgggaagttgcggatggtttaggtgtagaagtaaaggtgcaatcgctaaaacgtgttggaatgcatcgcctgaaccttgtaatgcacgctcaaaacggcgttgatccaaggcgctaacccattgttttgcttgtgctagattacattccacgtggtgtccctaccagaacaacaaaaatggcg

SEQ ID NO: 465 - DNA, 4629 bp, H. influenzae
  misc_feature (4574)..(4574): n = a, c, g, or t
  misc_feature (4599)..(4599): n = a, c, g, or t
atgtatacgaaatcggactcggtacccttctagccataagtctgtacacctttttctttcaatcgagcgattaactcattcaacaataatttccccaatccattaccttgatgagagggtacaatagcaatattaaacaaagtcgcttcatctaatacggtttggcaaatagcaaaaccgataatctgattattctctattaattttaaattgagataacgctcaccttgattattttttaacgtaccaaatgaccaaggcaccagatgtgcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgttattttctgatagtaaccagtaacgaataggctgcttacattccatatgctggatttgatcgtaattcaaacataaacaattttcttttttaagattaaggcttaacagcacatcagccaacaaaggcgagctactgatattttcattggaaacagtgataaagcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatctttcattttttgatggtaaatcggtattatttgctggcggtatttctgataattttcctcaaacattagcctctaaatgctcatcaatccaaatttggagttgctattttgactatgcaagaacacaaagtgcggtcaatttttccgttgaatttcaaggtcaagccgatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaattagaaacaaaaaaatccccatcgcaataatggggatttttctatttattacttatggatttcaccgcactttattcatccatatatcctaaactacgcaatgcacgttcatcatctgcccaacctgacttcactttcacccaaagttcgaggtgaactttgttatcaaataaacgttccatatcagcacgcgcttccataccaatagttttaattttttgaccgcccgcaccaattaccatttttttctgaccttcacgttcaacgagaattaagccattgatttcataagtgccacgttcattcactttaaattgttcaatttcaacagtaacagagtaaggcaattcttcaccggtaaaacgcattaatttttcacggattatttccgatgccataaaacgttgcgagcggtctgtgacataatcttctgggaaatgatgcacaccttcgcgtaaagattggcgtacaattttctctaattcatgaacattattaccacgctgtgcagaaattggcacaatgtgagcaaagttaaatttactgctaagatctgtaataaacggcaataaatcatctttatttttgatgttatctactttgttaatagctaacacaactggtgcttttgcatttacgtagtttgtttagcaccatctcatcatctgcattccagtgtgtaccatctacgacaaaaataattaaatcaacatcgccaatagcactacttgcggcacggttcattaagcggttaatcgcccgtttttcttcaatatgaagccccggtgtatccacgtagatttcttgatacgcaccttcagttttaatcccaacaatgcggtgacgggtggtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttccccgcacttttcactttgcattcaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccctgatccaaagacattgcgccaataatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcggtgcgtaagtgcctgctttaagagcgcaatatcattaaaacaatagccgattttacgctcaagtcgatctaaatgattcatcttattttattgctgtaaagaagcgatcaaaacggaaacctgttggccattcattcgcttctttttctaagctcatccaaatataagtggctttccccacaatatttttttcaggcacaaagccccaaaaacgactgtcatcgctgtgatcgcgatgatcccccatcacaaaatactgcccctctggcacaagccattctgcagtttgcattccctcttgtgggaaaaattcaaggtctgaataacgacgatactcaccaattaacacgttatgtgttacatcgcctttttcagtcaattctaattcattcggaaaagcaggatttgttggattttgtgtatattcaaacgccttggtttcgcaatcaacttcacaaggtttaccatctttgccatatacaatttttaatgttttttgttccacatcaaaaatgatgcgatctccgccctttccaacaatacgcttaatataatccacaccagacatattatcttttgaacttaacgctaaattttctgcaaaagccgctcgagtagccccaagaccagtacgaattaacgcttgttgtggtgctttaaacacaatcacatcgccacgttgtggtttttcgccctcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggcaactgaaaataatctaaaactttccacacaccaaagccgacagccaataaaatcacaaaaaataaatttgacataattttccttatttatcttttcctancgtgtaaaattgctaaaaacgcctnttgcggcacttctacgttacctaaagactt

SEQ ID NO: 466 - DNA, 3224 bp, H. influenzae
aaccacacgaagtgtagtaaaagacaaagtgagtataaaacgaaatggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagttaggagaaaatatgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgcataaggataacaaatgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgagggcaattattacgttagcaacggtcaaaatctacccgaaatgggcatggcatattgaagtatttagcggtggggcacaaaaggcgggcgcgcaattgcacgtaagggaatgaaacacaatccaacccgct

SEQ ID NO: 467 - DNA, 3591 bp, H. influenzae
  misc_feature (3501)..(3501): n = a, c, g, or t
gagggggagggggggaggggggaaggggggggggggggaggggggaggggggggagaaggggggggggggggggagggggagggggaagggggaaaggcaacactaacacaaaagggaaagggagaagaaggggaagaaaagaaaaggaatagaaaatcaaaggtagggagaacaaagtatcatgtaatcattgcagcaacaatattagataatcactcgaacattcccgcctatttccccacaaataggcgttttttttattcacaaatcgctaagaatccctataataaaaccttttaaaacataatttaggaaataataatgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaataaaatagataaaaaaataccgcactttggcaataaaagtgcggtattttttattgaaattttaatttagttaaacatcgcagaaatagattcttcgttgctaatgcggcgaatggcttctgccagcatggaagaaagcgtaagcacgcgaactttaccgatcgctttcatttcttctgatagaggaatcgtgtcagtaactacaacttcatcaatggcatcgctggctaaatttttggctgctgcaccagagaaaacggcgtgagttgcataagcaaaaacacgttttgcaccacgttcttttaatgcttctgccgctttacaaagcgtaccgccagtatcaatcatatcatcaaccaaaatacaatcacggtctgcaatatcaccgataatatgcatcacttgtgctacatttgcacgagggcgacgtttgtcaataatagccatatccgtatcgtttaataatttagcgacagcgcgagcacgcacaacgccgccaatatctggggaaacaacaattggattttcaagatcagattttttcaaaatatcgtgaattaaaactggcgaaccaaatacgttgtctacgggaacatcaaagaaaccttggatttgttctgcgtgtaggtcgcaggttaagacacggtcaataccaacaattgaaagtaaatctgccacaactttagcagtaataggcacacgagcagaacgaacacgacgatcttggcgagcatagccgaaatagggaatcacggcagtaatacgaccagcagatgcgcgacgtaacgcatctaccatcacaaccaattccatcaagttatcattggttggcgcacaagttgattggatgataaatacatccgcaccacgcacattttcattaatttgaacttgaatttctccatcgctgaaacgagcgactgttgcatcgcctagtgaaatatataaacgttcagaaatacgttttgcaagttcaggtgtagcattacccgcgaagagtttaatgtcaggcattttataaaacctcaggtttagattgtcgatgagtatgagttgatgatagctgcttcaacattgcgtgcaagggagacacattgagtcctttagcgacgaaaccaaaaaaatgcttctggtttttgtctaaataccgcttgcgcttctgcttcatgatcaaattcagcaaaaacacaggctcccgttcctgttaatcttgccggcgcatattgtagcaaccagtttaacgctttttcaacgtttgaataatgatttatcacaactttttcgcaatcgtttttataaggttcactcaaaagttgttcgagggattttttcggtgtattacgtggtaaatttggatcttgaaagatgacagccgtcgatattgaatcatcgggttttaatataacaaaccatttctcggcaggttcacaataagtgattttttccccaacgccttcagcaaaagcagcctgtccgtatacaaatattggcacatccgcgcctaatgttaatcccaattttgccagttcatcaatggataaattggcttgccataaataatttaaagagactaatgcggttgctgcattggatgaaccgccaccaacaccgcctcccattggaagaattttatctaaatgaatatttgcacccaattgaatattggctttttcttgtaaaagttttgcagctcgataaattagattattttccgtttttagatttggaatttctggcgttaaaacaatttgattatctttgttcccgaatactaatgtctaaccaatcgccaaaatctaaaaattggaaaagcgtttgtaattcatgatagccgttcggcaattttccattgatataaagaaaaaaattcagtttggcagggctagggaagcgtaatggctgccatttgattgtggttgattttgggcaaagagcgggagaaaattgaggggattccataatgaattccttagaaaccacttcgctacgcgatntttagggtggttttgggcggcatttttaaaaaaaatttcggcctccaatatttgaggatgggtgaaaaactgccgtctttgagaccctcc

SEQ ID NO: 468 - DNA, 5386 bp, H. influenzae
caaatttcattatgtagcaatggatttttccatatatcaccagtttatatttagaaccgataatgcacattctttttctacaataatctctaagtatgatcccattgctgtaatatgatcatttttctccagataggtaactattttctcaatccacgatggtttagctatatcatcagcatccattcttgcaaaatatttactctgaaaaacaaccaaggcctatattcaaagaatttatgaaccctaaattatatttattactgataatttttatccttttatctaatttagatatttcttctaaatgagacaaagtcaaatctgttgaaccatcattgataactataatttctagatttttataactctgattaataatggatgaaatgctttcatctatatattgctcagcgttataagcacaaacaataaccgatactaatgggggattttccatataagatccaattttacactcttatttaaattgttttatacgttatttaaataactagataaccagttaaaactctcctaaattaattgttttacaatagaaatttgagttttttaaatcactgtgattaaaacgccattcatattcctttaaaaatagcttaagaatatcataacctctgtagaaattcatataaacaatactaccttgtttaccttttctcgaataatcagtaacagtgttgcagattgcatattcataaccaccacggtgtatactttgctatttcgtttcaaaaaacaaattacgaagtttttccagcttatccttgaccaagtttacctttcagagcaccaccaaaatagctttcattcgcttgaatttcaccttcaaacatttccaaatgtaggctgctttgagtgataaataatggtagacgatgaaagtaataagctgaagtttatttatatttaccaacttagctgcagctagagctgtcacacttgccagaaatatctcaataagtttattttgcttatattgacttaagcgactttctctcatttgattatcttaacctaaatagagtttttagtcgttatctgtgacagctctagaattattcaaatccaaataattaacgccatgctttaaattgattgattaatccatttgttgaactatcgtggcttgcgactttttcagaatcggttaattcaggaagaattctatttgcaagttgtttgcctagttcgacaccccattgatcgaagctaaagatattaaaaatcacaccttgtacgaagattttatgttcatacatcgcaattaatgcacccaaggtaaatggcgtgattttttgaacgagaatggaattagttggcttattacccgtaaatactttaaatggaacaatatttttcacatcatccaaagatttccccgcttttacaaattcagcctcgacttcctcttttgtttttccgaatgctaatgcttctgtttgtgcaaagaagttggaaagcaatttattgtgatgatctgccaatgggttatggctttgagcaggtgcgataaaatcacaaggaattaaagtagtgccttgatgaattaattgatagaacgcgtgttgtccatttgtacctggttctccccaaataatcgggcccgtttggtaattgttaatgacattgccatcacgatccacatatttaccatttgattccatattaccttgttggaaataagccgcaaagcgatgtaaatattgatcataaggtaagattgcttctgtttgggcaccaaggaaattggtattccataaaccaactaaggctaaagtagttggaatatttttttcaattggagtagtgcggaaatgtttatccatttcatgcgcgccatttaataacgcttcaaagttttcaaagccaattgatagtgcaattgaaagaccaatagctgaccataaagagtaacgaccgccaacccaatcccaaaattcaaacatgttattggtatcaataccaaatttttctacatctttagcattggttgataatgctgcaaaatgttttgcaaccgcactttcatctttcgctgcttttagtaaccaatcacgcgcactttgtgcatttgtcatggtttcttgagttgtaaaagttttcgatgctactaagaaaagagtcgtttctggattgactttttttaaggtttccgcaatatgtgtaccatcgacatttgaaacaaagtgcatatttagatgatttttatacgggcgaagtgcttcggttaccatataagggcctaagtcagagccaccaataccaatattcactacatccgtaatggctttgcctgtatagcctttccattcgccagaaataatacgctgacagaaatctttcattttagctaacacagcattgacttcaggcataacatctttaccatcaacaagtactggcgtattagtgcgattgcgaagtgcagtatgcagcacggcacgattttctgtacgattgattttttcgccagtaaacatcgcttcttttgcactatcaagtgcgcattcttgagcaagttggcgaagatgtgaaagggttgtttgattgatgttgtttttggaaaaatcgacaagaatttggttattgaatgttaaagaataatcgtcaaaacgatttttttcttgtttaaataaatcttggatggtggtgtttgataattcagctttatgtgcttcgagagatttccacgcttgggtgtgagttgggttaatatttttcatggtatttcctttcattaaaaataattgaaattttaaccgcactttctggaatttttattagggagaatgactccctctgttcaaaaaatgcagtgattaatcaacgtattcagttataacacgaggtgttaattttgtaattagctcgtagcttaaaatgcctgtgaatttagctacggtttcaataggtaattccttgccccataaaattacttcatcgcctaccaaatcttggctatctgcgcctaaatcaacagtgagcatatccattgacacacgtccaacaattggtacgagacggccatttaaataaacaggcgtaccttctggcacatcgcgcggataaccatcgccataacccattgcgaccacgccaattttggtatctcgtggacttgtccaaataccgccgtaacctacaggatcgccttgtttatgatggcgaacggcaattaatgacgaggttaaattcatcactggcgttaagccaaactctttgccaatagtatcagttggagaaatgccgtacataataatgcctgggcgaatacattctaagtgagattttggccagaaaagaatgccgccagaagctgcgatagtgcgttcaccttgtttatcttttgtggcggataaaaaacgattgatttgaagttgggtgtaatctgattctagttcatcggctcggctgaaatggctgacaaagcctaagtgcggttgaatttgagggagttttttcagttcttgataaaaataatccacttcatcaagagcaacgcctaaacggtgcattcccgtatctatttttaaccaaaccttaattggacttggtaaatttgaacgttttaaagcctcaagctgttcgtgattgtgtaccacggtttcaatattattaacggctagaataggcaaatcttgttcattaaaaaagccttcaagtaataaaatcggtttagtgatgccgttggagcgtaatgctaaagcctcttctaaacgagccacgccaaagcaatcgacattttgttctaaagttgatgcaacaaacacaacgccgtgaccataagcgtttgctttaaccacagcaataattttgctatttggtgctttttgtttaattatttctaaattttgttttaaggcgtgcgaactgattttcgctgtcgccggttttacgttcattatttttccttaataatcatctcgatattcacgttgttcggcaagattgtcaaagcgtgagaattgtccattaaattttaaccgcactcgaccaattgggccgttacgctgtttaccgataataatttctgcaacgcctttatcttccgagttatcgttatagacttcgtctcggtaaataaacataatcaagtctgcatcttgttcaatagagcctgattcacgtaaatctgaatttacagggcgtttgtctgcacgttgttctaaagtacgatttaactgagaaagggcaactactggcacttgtaattctttggcgagtgctttgagggaacgagaaatttctgcgatttctagtgttcggttatctgaaaatgcgggtgcgcgcattaattgcaaataatccaccataatcatacttaatccaccattttcacgataaactcggcgtgcgcgcgaacgaacatcggtaggtgctagacctgcaagatcatcgataccaagattatccttttgcttgaacattccccactacgctagcaattttattccactcgatttcatctaaattttgacctgttcggattttagtttgatcaacgcgagcaagcgatgcgatcatacgcatcataatttgttctgctggcatttctaaactaaatactaaaacgggtttttcacttgccattgcggcattttcgcaaaggttcatggcgaaagtggttttacccattgacggacgtgccgcaacgataattaagtctgaaggttgtaaaccagccgtttttttatcaagatcggtaaagcccgtcgtaacacctgttacacctgaatgattttcaagtttgcttaaaatatcgattttttcaatggtactttctagcacattgatcacattttgtgggccttcgctagaagttgttcgtttttctgcaatcgcaaatacttcacgctcagcctcatcaagaattaacttaatgtcttgccctttaggagaatagctattttcagcaatgcgatttcctaccgaaataagttctcgtaatatggctttctcacgcacaatatctgcataagccaaaatattaatcgcgttcggagtattattagaaagctctgctagataggcaaatccacctacttcatcgctgacaccgtggcttcttaaggcttgatctagcgtaattaaatcaataggcgattgattacgcattagatgttccatttctgtaaaaattagacgatgctgaaaagtataaaaatcgtcagcaatcacacgttcagcaatgccatcccaatgttgattgctcagcatgatgccacccaacacggcttgttcagcctcaattgagtgcggaggaatgctaacttgtgctgtttttttgtctgaagatttgatttgaggttgtgatgccataggacttattcgatatagaaggggaccgagccgaatcgaacat

SEQ ID NO: 469 - DNA, 3494 bp, H. influenzae
ggcattcttgctgcctgcagttcactctatgagacccccttcttatggtggtcaataatgtcagtaatataagccattaaaagtaagctcttcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatagaagtaatcttaaataataatccgcacgtaaaatgtgcggattatttttacataggattaaaattcaaactgaacagacattctgtaatttctgccaggtgcataaaagcggtttaagccttcaccagtttctgtttttactcggttaattgtgccaagatgtcgaacagagcgagcagagtcccaagtgagatattttttgttggttaaattatatacaccagcggtaaatgtaagatttttaattggtttccaataggcaatcgtatcgatcactgtatagcgattattacgccataatccgcgagaatcttttacatctttgccgtttgcttttgtagcaggtatatctgttgcattgtcagtatattgcttttcttttctggcgaccatacttgtccattgagaattaaagctatcttttgctttttttgctgcaacattagtgatatacatatccacgccccatttttggcttggtgcatcatagccaatattgtataccgatgtggttggttgtaaggcattcattggttgaggtttacgagcaatggcttcgtattctggatgttcatctttattcaattccaaaaattctttatattttggatgtaatccattgtctttgattctgcctttttgataggtaaatttatagcctaaatggaaaccttgtagtttttcaaataaatcgcccatctcaagacgtgaagcaatttcgatacctctgactcttgctcgatctcgattttggttttgatggaacggatattttattgcagagccttcttcaataggacgttcgcccacttctactaagtcaataaaattacggtaatcgttttgaaacgcatttaacgtaatataactactgtttttataaaaagtgaacgcgacttcttttgttttggaggtttcagcttttaaatctgtgttaggctgaatggaaaattgtggatgtttaaatgtcatataaatttcatcagaggttggcgcacgaaaaccattggcgtatttaagctgtacacgaagccaatttgtgggatcaagatttaaccctaaattgtaagaatgatgtttatagtcagttttgcgtaataacagggcaagattgtcttcaaaattttttttataacacggtgtgtcgtaagtgcaattttcatatcctggaggtattgagtatttactaccataaacatattcctttgagctaaatttcttaaatagcccagtaattaatccattaggaacaggaatgtttttgtcataactaggcaaatattttacgtggtcataacgataatttaaatctagtcctagccaagaggtaagttgcacattatctccaaaatacaacacattatttttagtggtaacagggattaaataggtatctttacctttattggaattcattaagctacatctgtaagcactatgatcaggtgcaggagtatgctccacaggatatgtgccatctacaggtttgttacagaaaaaattgccagcccaccattgcacattggcaacagtgtagtattgatgattcaccatactttttagtgttttttcataaagtccaccatattttagttggtgttgggtatgccataggtgaaattctttgtctaaatcaagtttaatttgttgggtatgggtgtttaaatcacggtcattaacgaagtctgtgctgtagccatggctttttggaaataaaaatttagcactttcatattgggttaatccataattaccttctgctgattttagtgagatttcaccatattttttgccatttaattctttaatggtaatatttcggtcttcataattatatttgtcattcccattttcatcttttccaacaaaaacctgaaattttttattacaatttaatttttcacaattaattaagaccgaatcaagtgagcctccttctgtatctacatcattactaacatcttcaccctttttgttttgtagttctaagccataattatattttcctgtaaattcttgattgtctttatctttaatcttataaattccaccttcttctactaaatgtagcccttgtggattacgtacaccagcacaagtggattgatgacaatactcatcagagcgtgctttattggtaattttttgtgaggaataacttagtttaatatgatcccaaaaaggggtttgactgaaattttcataactaaattgaatattttttcttttagattgatcattaataactcgctcgccatatttttcctcacatttagtatttttgcattgattgaaaatataagacaaatccataccctttgtttctaaagtggaatcatctaatgccacgctcaagcgatggttttcattaggctgaaagcccaattttattaatgtgctttggcgggtaatttgataaggatcggctttttcacgggtaggaccaaccgcacttaaatccgcctgtttattgggataaattttataatcgtagttttctatttcgtgcccatcacgttttgtatcaacgactaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcaccactaccggattttaaggagtcagcacctttggtaatagttgctgttttaacattttcaatttcaatgctattacgagtattattaaaattgccatagccttcaaataattctttaaatccttgagagcttaaggtttcagcttgacgaagcccatcaaccataatacctacacggttttcatcaacccctcgaacagcataaccacttgcgcccgttctacctgtttcaaccaccgtaatacctgtttcatagcgaacgagatcacgagaatcagacgcctgctgtttcgctaattttttggcagaaatttgggtttcacctacctttttctctttcacattaattgtttctgtacttcctgaaacattaatttgttctagttgttcagaaacattactattttggttggttggttggttggttggttggttgg

SEQ ID NO: 470 - DNA, 4019 bp, H. influenzae
  misc_feature (890)..(890): n = a, c, g, or t
  misc_feature (921)..(921): n = a, c, g, or t
ggaattcggctcggtacccataacgcaggtcacacacttattatcaatgggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcacgttgcaatggatcacgcacgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagatatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggctctggttttggcccgcgtaatcttgattatgtacttggtatcattaaggcttactgtactcgtgtaggtggtggcccattcacaactgaattatttgatgatgtaggtgctgaaattgcacgtaaaggtaacgaatttggtgcggtaacaggccgtccacgtcgttgcgggttggttcgatgccgtcgccattcgtcgtgcaatccaacttaactctatttctggnttctgtatgactaaactagacgtattagatnggtttgatgaagtaaaatctgtgttgcttaaaaatgccaaatggcgaaatcgttgaatatgcaccgttagcggcgaaagatgggaaggtgtagaaccaatttatgaaacattaccaggttggaaagaaaatactttccgcatcacagatgtaaataaattgccacaaaactgcattaactatattaaacgtattgaagaagtaactggcgtacctattgatattctttcaactggccctgatcgtgtagaaacaatgattttacgtgatccgttcgctgcttaatttcttttgattttcagaccgcactttaaaagtgcggtctttttttatattttttactattcttcaatagaacgtaataattcattgatgcccacttttcctaaagtttttgcatccacttttttcacgatcacggcacaatataggctatattttccacattttgatggaaggctacctgataccaccacagaacctgctggtacacggccgtaatgaatttcgcctgtttcacgatcataaattttggttgattgaccaatgaatacgcccattgaaataacacaaccatcttcaacgataacaccctcaaccacttctgaacgcgcgccaataaaacagttatcgccgataatggttgggttagcttgtaatggttctaacacgccgccgatgcctacaccacccgataaatgcacgtttttaccaatttgtgcgcatgaacctaccgtcgcccaagtatctaccatggtgccttcgccaacgtaagcaccaatgtttacataagatggcattaatacgcagtttttagaaatatatgcgcctttacgcaccgttgcagaaggcacaacacggaaaccttcttcagtaaaacgttcttcagtgtaatccgcaaattttaatgccactttgtcgtaatattttgtttctgcgccgtcaatgatttggttatcgttaatgcggaaagatagcaataccgctttttttaaccattgatgtgttacccattcgccagcaattttttcggctacacgatattttccagaatctaatccttcgatcacttcttcaattgccgcatgcgtttctgcatcaacggtttttggtgtaatttctgcacgtttttcaaatgcagcttcaataattgcttgtaaatttgacatagaacttcctatatatgttgtgaataaaacggcattagttttaccatattttaaacgggcaagcaaaacaccgaaaaaaaatcaccgcactttgtagaaacaaaactgcggtgataataaaaagttgatttgattaaaagattgaaagtgcaagccccacgacaacagacatactaaaaacaaccataatcattgcataaccaaaatcgctcattttgttctcctcataaaaaaaataacgcagacattctagcaagaataatacgaaaaaatcacttctttttataaaaaatttgcaataaagatgactaaattctcaacaaacctttataatagtgaaaaattttttagggatttaaatatatggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttatttttgtgtaacacacaaaatgatcctgaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggtcataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagaggaattaccaaccgccctattctgctgtaacgatgtgatggcactcggtgcaatatcagcactaacagaaaaaggcttgcgtgtgccagaggatatgtcaattatcggctatgatgatattcacgcctcacgtttctacgcaccaccattaaccaccattcatcaatcaaaactacgtttaggcagacaggcagtaaatattctattagaacgaattactcacaaagatgaaggtgttcaacaatatagtcgtatcgatataacccctgagcttatcattcgaaaatccgttaaatcgattttataaacttagcaaaaatagaccgcactttttaaataatccctaaaaagtgcggttcttttttagctattttttagcttttcttgattattttcaaaatttctctgaatagcatttgccctccaccctatttttagttatatctatcgccaactgacaaattttattttttacttttaggagttcctatgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgcttcagtcaatttttaacctcactacatagcagaacatatcaaccatttcccggaacattctcttgcacaagttcttctcattccttagcgactttcaacgcttaaaagacaaatgcttaatggaagagtgcataaaaccgcgaaaatattatt

SEQ ID NO: 471 - DNA, 5085 bp, H. influenzae
  misc_feature (4896)..(4896): n = a, c, g, or t
tcttaaacctgcatcaacaagcacaaagcctttttggatagctactacagtaccgctaacgattgaaccttgacgagtttcaaggccttttaatgattcttcaaaaagttgagcaaaagattctgacatataaataatcttcttaatttaagttaataacatccacattaaaatccataaaatgcggggttgaggataaatgcttattcttccttgaacaaacagttaaatctaaactgataccttttcttgaatataagacaacgcctgatcgatcacttcattgatactcaaggctgtgctatccaataataaagcatcatccgctggttttagcggcgcaacttcacgatttctatcacgaagatcacgctcttttatctcggctaaaatctgtgcaaagttaccatttattcctttattttgcaactgtttatagcgtctttttgcacgttcttcagcacttgcatctaaaaataattttacttgtgcatttgggaatacaactgttcccatatctctaccatccgcaattaatccatcatttttcgcaaaatcttgctgaagttgtaataaagctgaccgcactttttgaaaaactgctacttttgacgcagcatctgccacttcttgcgtgcgaattaaacggctcacatccattcctgcaagcaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacagtgcatagcccaacttttcagccaacgcgtaacaaagcgtccctttcccagcaccactaggcccatcaacagtaataatcattcccatacaaattatcctttcattatcaaaattttgcgcattatagagacaatttcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacactagacattatgccttttaatatatacgcattttttcaaacttgttctaaagacttttctacattacaataaaaaacgtagctatcaatacaaataaccaaataatgaggacaaagaaatggctgaaaatcgttatgaactaaataaaaacttagcacagatgctcaaaggtggtgttatcatggatgttcaaaaccctgaacaagctcgcatgccagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagcataaaccattatctgcatatctgccctccctaggaaacaaaccatattgtagcaatgagagcagataattttcatcaaaaacccgaccagttactagacttaaaaccgaatgcaaggtaggataaggttgaacaaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcaccgacggcttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggatccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataagtttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagtttgattccgtcaattcgcattgtattgatgacgacaatatcgcgatcataatcattgccatctggtgtagagccaccagttaaacctgtattcgccgcttggtttataacaataacatcatgttcaacgcanacttttacaatgttccaaaactcaagtagagtggcagggcgaacacagctagggcgtttcctgttccaatcgataacacttcgatagcttctgtttagttggatcagtataatataccggatccacattttgtccgtcgcgaatgattggtgaacaactattatatccctttgtataaaatagagtact

SEQ ID NO: 472 - DNA, 5466 bp, H. influenzae
  misc_feature (1636)..(1636): n = a, c, g, or t
  misc_feature (1647)..(1647): n = a, c, g, or t
cgaattcgactcggtaccccgcagagcctgggctgcagcaatcacatcttttgttaatgagccatagttataggcataagatgttaatgcggcttgggcatttggcggtaacttatcccatgttgaagatgatacgttatttctcgctctatttgcaaattcttgtgttcgacgtgctaaatcacgctctgcgtcagcgcgactaactacagtatctttcgttactttgacaattgtaccatccgcttttgtgatagtatctgaaccatatccagtgcgataagcattgacatcccaatatgctttatcactaaacccttcaaattttttcaacaaccctgtagcttgatcaagtgcagtccctttaattgctggaactgatgaataagaagtgttacctctactatttccggatgtaccgccagtcccggtgtaagacagggagtttgacatctgaggcacttctaaagtgacattgttacgaggaatattgatattgtcagcatctgccaattcagcagcattgctattcgtaccattagctaaatcgctaatccgtttatctacactgtcacgtgtaacatttccggttccagtgttatattcacgtagctctttattttgtaggattgcaactgcggaattcccggtaagtgatttttgtagatcaatctccattctaatttgacctatttctcggtcaattaaagtgaggatcttttctaactcttcttgagcatctttattgttggccacatttggctcacgcatacccgttaaaacagctcgacgtgcaagaagcattttctccattgttttagctacagcaatttcactggctaaacgctgccctaatacttgagcatcgggatcttctcgtaaagactcaattaagccacgagttacaggaactgttgtagaacttaattctgcaagtacttcaacggaaggagtgctcatgttaagcgctttttgtaattgagttaccgtcttaatattttctttttcaatttcaggtgttaaaccaacaccagctcgagagctactagcagtaccacaatctgttttacaagtagttaattgcttctcaccgatcacattcgttaaccaatctgtcatatctttaggattatcccaagtttgacaaagtaatccgctacaactactaccggagattcgacctgattctaatacattacgcttgttttgcatgttgtagccagcttttgcaacatcctcaacaattttgattggttcttgtccttggccaccgcgttttttacccccgacccactctttaccttccttaccttgagattcctcaagtctctttttagctcgagtagcatctggttcagttgaagtaatgtctttaaaggattccatatccgaactttgagaccaacgaccatttaaagttgcgtctgcaagcttcttagacatttcttcacagctggtttttaagctattaaaatcaattttaccttgatataaaccattcgtaagaatatcgtataactgaggatttgctcgttgaataaccattgcaggtaaactcgccacagctcctgtggctgattcgataacgttactataaagatctttaaatccttcagttaaaccatttaactgattnttaatactcgncttaatgtcaaaattaccgcacatcaagttagctttccaaccaatcccaaatcagctgcaggaatcgtacctcgactcgggggagccatataacctacaccgcccccaatttgataaaacaccatatcagacaaaatagaatcggctttattaaatccaaacggattactattagaagctgatactggcatggttgaggataagattgcgcacgatatagcaatataagatgctttcagtgcatgatttaatttcatactcaattcctttattaattagaccaatcaatactatacaaaaatgtttgtccgcgttttttacagcacttgtaagggcgccataatgcccaggcataactaccattttcagatagcatacttggcgggttatcagggaaaatagcacaagactgtgaagtaaccgggtgaagctgttgccatttatgtgtcttttcatccccttctttcactggagggggaaaccactcaccattcgattgattatcttttttcgcaatcggtatatatacatgtggttggaaagtatttgtcacaacatccgctactcgatgcgctgttacagctgaagctttatagtcatgaacttgtgttactgtacccgctcgtggataaatatttccccaagtgtctccatttgctctaatttctctcatacctggaataagcgcttcaggataaaccatttccggaacaccaaatcgccacgctaaaaagtccaaaccactcaagtaataaggcacaaaaggcgttgtctgacttttgcagtaataccctgtactattaagcatttgactaatcgctccctgcggatgaccgattacatcaacatttttaaatgttgcttgcgtatagtctttgtgtggtgattgataatctccaccttttaccccattgctaaggaaattcatttccacccaaggattttgagcctgatggttataacttgaaaccactacctcgggaatatagtgttttattttcgtagatgtccggattttacagccgaattttgtacaaaatagccaaaaacaagtaccaacgaccttataatctaaacaacttgtcgaagcgcttgatgccataatcgatgcagtgtttaaagaagattgaccggactccgaagcttgtcctgaaatactggtcaacgcaattgcaatacaaagcccggataatgtcatttttttcaatttcatcttgtcccctcttttgtaatctctcgttgccataaacttaatgcctgagcaatattggtttcaccatatatgacactatcctcttttcccggatattgaaataaaactgcaggcaccttcttgattccattttgccaaccacttataaggccctgataagaacgctttaattgctcttcagactgtttccattcagcagactgaaaaatctgagatgcttgctgagctgctacactaggattcgcactcaatcgctgactaatcaaattttcccattgctcaacttgatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcaacgccttgccttagtgcaagtagaatcatagccaaaatgttatccagcattctgaaaggatactctacgcaatcgtaggaatgccaccttaaagaccttccgagggaaaatgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcattaacattgcataagctattcattttcaaccctaaggggaatttttacccttagaggtaaaggtttcccttgctgtaggagaaaacttatgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaagggggtaaacatgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcgtaacgtatgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattcataactgaattaatacctgcaacctttacaacaaaccttgatcatgccattggcgtgttcaaggttttcttttacccgactgggagcaatttcccattcggggggttgttccctttttttattggagaacaaccatgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacagggtaccgagtccgatattcgtataccag

SEQ ID NO: 473 - DNA, 3862 bp, H. influenzae
  misc_feature (3814)..(3814): n = a, c, g, or t
  misc_feature (3827)..(3827): n = a, c, g, or t
  misc_feature (3834)..(3834): n = a, c, g, or t
  misc_feature (3856)..(3856): n = a, c, g, or t
acgatatcgactcggtaccccataaattattgagaatttcttgatttaagacattcaatctagccaaatccagctgattattcaataagtccacatcgggcattgttttattggcttttgcggaaagggttttaaatcgttctactttgccaactaaaccttgttggccaacaagtgcggtgacggtgctgttgtattggttgctgacagtggaaagcgtattgccgagtttacttaaacgttctgccaccaagcaaatttggttatagatttcgcccgctttttcagcaatttctttggcttcagcattaccacgttcgatacgccagaggtttgccacggtgcgtaaaatcggcattagcgtagtgtgagaaaccataattacattgcgttcataaccgtaattaaataaggcaggatcagcttttaaagcctcaatatacgcaggttccaccgcaataaacataagaacaaaattcggactacgcatgccaatcagattgctgtaatcttttttatgcagatcgttaatatgggtttttaatgcggaaatatgctctttgagtaaacgctctcgttcaaaatcatcctcagaattcaccgcactttcgtaagccacgagcgacattttgctgtcgataattaagtgtttttcatcaggtaaattcaacacaaaatcagggtaattacgcccgccttgttcatctttaaaatgagcttgagcacggtaatgtacattttcttcaagtcctgccagttgcaatgctcgttctaattgcacttcgccccagttgcctaacgttttcttttcgcctttcagcgcagaagttaaattactcgcctcttgcgacatattcagaccaatttccagcacttttttaatttccgcttccaatccagcattgcctttcacggattcggagtgaatttcattgacccgtttttggaaaccttcaatttgctcacggaaaggcttgagcaaggtttccaatgccgtttgatttgattgactaaatgatcgacttttttcatccaaaatacgatttgctaggttttgaaattccacactcaactgcagcttagattgttcaaagttctgttgttgtgcggaaaaatatttttctttctctgttaaggttgtttgtaaccccgttaattcttgagaaagtgcggtcaatttttcagtcaaattttgtcgttcttgtgtgagatgatgtatttgttcatcacgttcagttaaacgatattgcagtccttgattttcagtctgtactttaattgtttgttgttcaaactggtttttaatgctactcagttcatcaaatttactggcaagctgattataatcttgagtcgttttcgataattcttgatgaagatgtgtatatttttgctggcgtagaataagtaataaaatcaatataataacaacagctaacaagctgaaaagtaacaaattttctgacatatttctctcttaatggaaaacacaaattgtagcaaaaaatattattttaattctgctttaaagtgcggtaaattttttaactgatttagaatttatatccatacaaaatttaattattttagtcaattttgatggcaatgctttagaaaaacattggtgtattttaacggtatttatctaaaaacttgtaataccgcacaccaatctttgtcgcaagatctttgataattcgaccaccataaacagaagggactttcagtccttcaaaaatagataaacgttcatcgtcacccaaaatcgcctccgctacaattcgccccgcaagaccagtcaaagcaacaccgtgaccagaataaccatgagcaaaataaatatgcggagaaatacgaccaaaatgtggcgttgagtttaaggtcatatcaatcgggccagcccagccataatcgatttttacattttcaagttgcgggaatacacacaacatatttttccgcataatcgcgaccatatctttttctgagctagaatcactaccaaaaagcaagcgattgtcagcacttaaacgataatagtctaataataaattgttatcacacaccgacatgccattattaatgacagaatcagcaaccgcttggcttaacggctctgtggcgataataaaactttccacaggtaatattttacgattaatgccgtgatgaatagatttcgggagcgcatcaatataagcattggtggctaaaataacgtcttgagaaataaccgcacttttagctgttttaacctcaatgcaaccatttttctcaaccatatccacgacaggagattgttcaaaaatctgaacacccagatcgacacaagctttcgctaaacctaagcaataattaagtggatgcaaatgccctgaattactatcaaatagcccccccacataaatatcactgcctaagtgctgttttaatttagttttatcccaaagttgcatattctgatagccaaaatttttatgactttctttttccatttcaattaagtcatccattcggcgttcatttaatgctaatgtggcatagccttttttccagtcgcattgaatgctatatttttcaatacgttcatcaataatatcaatggtctctaatgacatattccaaagtttatgtgctttatcttcgccaacttgtttaacgtattcatcaatgccttcttcaaagccattaattgcctgcccaccactgcgaccagaagcaccaaagcctactcttgcaccctctaagacaatgactttttttcctttctccgccagttctaatgctgcagataaaccaaaaaatccagccccgatcacacatacatcagcatgttcaatttgagtgagcggcgggaattgaaaatcttggttacgagagtcgaaataataagagcgaacgtgttcttgataggcaaaattaagcataaaaaatcccttaggaaaaaactggcaaaatcttaccccgaaagggaaatatgtcaaaccttttagaaaaaatgctatactgcgcgcacgcaaaatttgcgtgttttatgatgaacgataaccctcggaggtcaataaattgaaaaaattctttgctcactcactcaaaaatcttttcctttccaccaccgcacttttgcggcttccgcttttgccaataacaaactttacgtctataactggacagactatgtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttattagcgcagaaagaaaatcaatctcttcaatttgtgtanccaaggggatctntagagtncaaaccgcgaggcatgcaacgncatggc

SEQ ID NO: 474 - DNA, 4625 bp, H. influenzae
  misc_feature (4434)..(4434): n = a, c, g, or t
gaacgcggacaaaaactctcattacacggctgggtatatgatgtaaatgatggatttttagtggatcaaggcgtaatggcaaccagcagagaaacccttgaaatttcttatcgaaacgctatcgctcgtttatcaatacttgatgaagaaaatattttgaaaaaagatcatcttgaaaatacataaaaaaacgcccttttgggcgttatttttttaagctttaccgtcagccaaatttttcttttcttctaattcttcccagcgtaaaaatgctgtttctaattcggcttcagtatccgccaatgcttttaatttagcgtcggtaatatcgtgagcctgttggaaaaatgctggatcggctatttcagcttgaagtacggtgattttagtttccaactcttccaatagttgtggcagctgttctaactcacgttgttctttataagaaagtttcacggatttcggcttagaagtgcggtcatttttcaccgcactttcttcttttagcggttcagttttcttcgctttagcctgctcttccactgctttacttgcccagaaattggcttgttgctgtttcgcatcaaagaatcctcccacatacttattcaaatgcccttcaccttcgaataaataacattctgtcgcagtattatcgataaattgacggtcatggctcacaattaacaatgtgccttgataatccgtcaaaatttcttctaaaagctccaatgtttctacatcaaggtcattggttggttcgtcaagaatcaataaattatttggttggagcaacaattttgcgagtaataaacgatttcgttctccccccgataaggctttaactggggtcattgctcgttttggtgggaacaagaactcttgcaaataccctagcacatggcgttttacaccattgacttcaatatcttgtttgccatccgccacattatccattacagttttttcaggatctaaatcagcacggtattggtcaaaataagcaatatctaatttagtaccacaacggattttgcctgatgttggctgaatttcacccagcaataatttaatgaacgtggttttcccacagccatttggcccaacaagcgcaattttgtctccacgtaaaatcgttgttgaaaaatcttttaacaaggtttttcctgcgatttcatagctcacatcttccatttcaaagacaattttgccagaacgacttgaggtatctaactgtaatttggctattcccattacatcacggcgttggcggcgttcctcacgcatcgcttttaatgcgcgcactcgcccttcatttcttgtacggcgagccttgataccttggcgaatccatacttcttcctgtgcaagtcgtttatcaaataattcattttgcaaggcttcaacgcgtagattttcttctttcgtggttaaatataaatcgtaattgcctagataagactgcaattgaccgcgatctaaatccacaatgcgtgttgccattttgcgaataaaagaacggtcatgggaaataaatacaaggctaccttggaaatccagtaagaaattttccagccattcaatagcttccacatctaagtggttggttggttcatcaagtaataacacatcaggatcgcataccaatgcgcgtgcgagagccgctttgcgtaaccaaccgcccgaaagtgcggataattttgtgtttggattcaaacctagttttaacaacacttcattgattttattttcaaatcgccagccatcagcgtgttctaatttatcctgaacttgctctaattgacttaaaatttgatcactgtaattttcttccaattgaacagaaatctgatgatattctttcaataaatccgttaaatgcccgacaccttccgcgacataatcaaaaatattgccttgcgcattacgcggtgggtcttgttctaaacgagaaaccacaagatctttttcgtattggattttgccatcatccataagcacatcgcctgcgatgattttcaataaagttgatttacctgcgccgttacgcccaactaaacaaacacgttcattcggttcaatatgtagttctgcgtgatccaacaaaggtgcatcactaaaggaaaggtatccattggttaaactaattaatgccacagctgccccataaaaattcagtgaaaattaaccgcactattctatacggtttgcataaaaaatcccatcaattcaatgggattctctcttaaatcaaagttgttgatatacccgcaatgcgtgtgcatctgacatgcctgcaatataatcgcaaataattcgcttcttcccttcttttggtgcattacgccaacgattttctgtatttcttggtaataaacgctccggatcagattcaaaaatctggaacatttctgttagcattctctgccctttatattcgattcgttgggtatccacattgcgaataacataatcccaaacgaattttttaaatacaccaagcgcagcaatcacttcaggtggcaactctgcgttataacgtaacaaaggttcatcaaaatttgccgttaatttccaccgcacattagtaataaaaaagttcaccaatgcaccaatcgcctgtttgcgctcaaaatgtttatccgagaaaagtcgttggctaattgaatcaatattttcatgtaaccaagctgacggaatttgtttcaatgcaacatgtgccgcttgccattgatgaggatttaccacgccagttacaatcgcatcttctaaatcatgtacgccataggcaatatcatccgccaattccataatgctgcaatccagtgatttaaaccgagtatgtaaagattcagctggattttcccgcacttttttaaattgacagaataaagtgcggtcattttcagaaagattttccagcaaccaattaaacatttttaaatcatcgcggaaaatgccttttcctggaatccaatcatgaatacgcacaaaacgaggatcaatgttgcgagaaaaattaagttctgcatattgaggcgaagccacacctaacaacgcgggatatttcactacacccaatagtgttcggcgcgttagattcatccctgcattttcagtgtaaggctcaagtttcgttaaaattctaaaggtttgtgcattgccttcaaaccctccctgctctgccatcatataatttaatgccgtttcgccaccatgcccaaaaggcggatgcccaatatcatgagcaaaacacaaactctcaataagatcgttactcggcaataaaggttttaattgtttttgcaactcgtttttatcaatatttaatgtttgcgaaaggctttcaaaggtttctaaaaatttaagctgtgcaacgaggctgctgccaatctgtgcaacttctaaagagtgagttaagcgagtacggtaaaaatcattttcgccaattgcgtgaatttgggttttcgcttgtaagcaacgaaaagcggcagaatgtaaaattcgcccacgatcccgacgaaatggtgggcgattatctttttcgcgtggaggatcaggaagaaaacgttctgtccaagaagaatcaatgataagtggtttcatatcgctttgttttatttcgtttttctgcattatctaatcatttagcgcaaaaaacaaccgcactttatctataacaaacaaaatctagaatgaataaagtgcggttgaatttttattgatatttaaacaaagaaataaatcagcttaaatacaaatggcgcgagaatagaactaataatcccacaaagcacaagagaaatagaactgtaacttcccgctgttggattcgtttccatacaacttactgtaccgagcgcgtgagaaaccgaaccaacagaaagcccaatagcttcttgatgtttaacacccaatttttttaatacaagataaccaaatatcgatccttgcaaacctgcaaccacaacaccaactgcagttacggcaggaatgccgcctaaatgacgggaaacttccatcgcaataggcattgtgatggatttaggtaaaaccgtagcgaccatttcgggcgttgcacctaaaagaaatgctaaaagcccgccacttaacatcgccaaaaaagaggctataaccaccgttgaaagaataattttccattgtctggcaatttggcgaagttgttcataaagaggcaatgcgagagcaacgatactcaagccaagtaaattattaataggcgcatttcctgccatataatcatcataaggaatctttcctatcactaaaatcgccgccaaaattaatactgttaaaacaaaagtattaaaaatcattgacttccaacgtttgctaatttgtagtgcgagccaaaacccgaaaattgttaaaaatgtataaagataaataatgtactgctgcatataaactttncttacatactaatttcgcttgttttacctgaatttctcttacgtttattacttttttgcgtttatgtgtaaaagaatgcatctgatacaaataatgacctaaaattctatacaagtaagtggcacaggtcttccaattttggaacagcaaaatttaatttgtttatcataaataggattattgaaattccc

SEQ ID NO: 475 - DNA, 4724 bp, H. influenzae
  misc_feature (2104)..(2104): n = a, c, g, or t
gccagcttgctgcctgcggtcgctctaggacccccaacgctttccgtgaagtatgttgttattgaataatatcttattaatgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaatagtttatactgccatgggtaggtatacccatggctaattgaaatggttcccctttggggaatttcaactagcctcaaagaggctatacttttactagcctagggtatacttaccctaggcactaattttaaagtgcggtaaaaaatgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaataatgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgccaacctaaaacccaaagtgcggtgaaatcccaagaggttttaacggatgaagataatgcgcgtttggcagaattattaaccagggataaatagatgaantttacattaatttttatcttaacccctttagttgtggcgttaattttggttttatcctttatttacgtcatttaaagcgaaacatgggcaaaaacgtgatgatttaaataaggcgttatatttctcacgcttggaagaaattgagcaagataattcccaaggtttagttgaaaatgttgagcaactcaaacaagaattacagaaacccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttagataaaaaattatcttgttatctgtgctaaaaattcttcttctgttaatactgtaatatttagttcttgagcttttgcaagtttagagcctgccccatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcactcgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtgggcttcgcccacttcacgaatgcctaaagcaaaaataaagcgatcaagcgtcgtgctttttgcattttcagactattgagtgcgttttctgcagattttgcacccattctttctaagcgtgggagcgggggtaaatcaagtttaaataaggccgcaggtgtatgaattagctctcgatcgactaaatgctctattaatttttccgcctacccatcaatatccattgctttacaaaagacgaatgtgttaacgcctctttaccctgggccgacagaataatcctccgggcaagggctactggtcggctttatacaataatttgagatcgcccagggcaat

SEQ ID NO: 476 - DNA, 4925 bp, H. influenzae
  misc_feature (4382)..(4382): n = a, c, g, or t
  misc_feature (4893)..(4893): n = a, c, g, or t
  misc_feature (4899)..(4899): n = a, c, g, or t
tagtgattaaagatatatttatgatggcaggtggcttaacagctgcagcagagtgtgcaaatcgaattttagcacgtaaaaaataagtttatcgatataaaaacagctccaagtataaattggagctgtttttattatcacgactagttaaatattgatcattacgttttgtattattaattcataatgcctttatgtcttaataagatgtctaattgttgatatattaaatttaaatctttccaccaacccctttaaatttctctacaaatgcagcaattttttggaaaattgtctgctttttagtgagatattgtggagtaagtggactcatttttggcaatacttcatttaacgctgtgccgttttcactggcatattcgcgttttaatgaagtgctgatatagcgttttgctgcatcgacattcaaattttcttcttgaattaaggattctgcttcttttcgctgttctgcttgagcaaataggaagaatgagtcaattaaagtcgctttatcgggaatatcatctaaatttgtttggttgataaaatcgacaatcaagctctctttagcacggttacctaaacttgaacgaactgtgcggcggatttcatcaattaacacctctttgtcttggtttttcttatgatgctcgaaaattaacgcaagaatataatccaaattgatttcttgagattttaataaatccacttcaaatacgacatcgtcccaatttatcggcgaattatctttatcattcccttcttttctttggcgtagccaatcgcgaatatcattataagttgaacgataatcttgctccgctcttactggtaaagtgggtactttcagcatttctgcaatttgttcatcattcacataatgtacttgcttgaatttctccattgcaatcggatcatttaaatcgaccgcttgtaaggcttgcaatgctgcaaactcatcgtaattctgcaaaatattttcgacacgtagatattcgccaaataattttacaaactcttttttatcttgctctgtttcgatttctgttggattaggaaagcgattttgtagctcttgaacaacctctaaataaccacgttgattttcatcaccattaaaataggtttcgtagcttttctctaaaaccatatttttggtattgtcatcgccaaatagcgtgattgcatcaatggtattttgttccaaatcgcggaaagtgacgatattcccaaaggttttagttgtgtcataaatgcggttggtgcgagaaaaagcctgcattaatccgtgataacgcaagtttttgtccacgaaaagagtattcaacgtaggggcatcaaagcctgttaagaacattccgactacaatcagtaaatccacttcctgatttttcacacgtttggcaagatcgcgatagtaattttggaatgattgactatctacgccataattcgtgccaaagtagtgattgtaatcatcaatggcttttgttaaaaattcttttgccgtactgtttagagcagtgggttcaaaggtctcatctggaatatcgccaattgcatcttgttcttcattggcggcaaacgaaaagattgttgcaatttttaacggatgctcctgctctgcctgtaaattttgtaaggtttcgtaataacgttttgctgcttccacactgcttaccgcaaacattgcattaaagcctttacctgtggcattcaagcggtgggttttttgtttaaaattgttaagcaaatattgcgagatttctttaatacgctcagggtgtaaaaaggcttgtttctgctcaagtgcggttaatttttcaggatctttttctgtttctaaggctttaaattgtgggcggacatcgttgtaatcgaccttgaatttcagtactttgtcatcacgaatagcatcggtaatcacataagaatgcaattccgtaccgaacacacttgttgtcgtttccgcacctaatgcgttttcagggaaaataggtgtgccagtaaaaccaaattgatagaattttttgaatttacgttttagatttttttgtgcttcgccaaattgggagcgatgtgcttcatcgaaaataaagaccacctgtttttgataaatagacaggttttcttcacttttcattaaattattcaatttttgaatggtggttacgataattttgttatcatctttttcaatattgcgtttaagcccagcggtactttccgacccattcacgctatcaggcgaaaaacgctgatattctttcatcgtttggtagtctaagtctttacgatcgaccacaaaaaagactttatcaataaaatcaagttcagtcgcaagacgagatgctttaaaactggtgagggttttgcctgagcctgtggtatgccaaatatagccaccactttctttgttgctccaatttttggcgtgatatgaacttttgattttccataaaatacgctcagtggcggcaatttgatacggacgcataatcaatagagtgtcggaaacatcaaacacgcagtaatttaccaacacattgagcaaagtattcttttgcaagaaagttgcggtaaaatcctttaaatctttaatcagagtattttttgccgttgcccaattcattgtgaagtcgtagctattcttattgcgtttagtcgtattagcaaaatagcgagtatccgtgccattagaaatgacaaaaatctgaatatatttaaagagagaattttctttattgaaactttctttgctgtaacggtgaatttggttaaaggcttcacgaatcgccacgccacgttttttcagttcaatatgcacaaggggtaaaccattcaccaaaattgtcacatcataacgattatcatagctgcctgtttgctcaaattgattgatgacttgcagagaattattggcaagatttttcttatctagcaaatagatattctgaatgcgtccgttatcgaacacaaaatcataaatataatcatcgtgaattttgcgggttttctcaatcagattatcgctcggtttatccaaatattcctctaaaaaacgttgccattctgcatcggagaaaataacattattcaaccgttgtaattgaacacgtaagtttttaatcagttcatcgtgattattaagcccttgtaaatactcatagccttgagcctgtaaatcacgaataaactcacgctcaaggctcccttccgtttggtaaccagcattaggttcttccacaaatttattatattgatctaaaacgataaaattattggattcagcgatagttttgtattgggtcataagtagttccttaatgcttttgctttttcagatctttctgccagttttctaaaatttctaaatcttcattatcagcttgtatgcgtttttgttgttttctgacctgatcaaataaggcatattgttctttggtaaaggtttccatttgttttacggttcgggttccattaccgataagcaacggaaaaccgttaaattcaattaaattatcgacattattacgccagaaatttaatgtgagatcttgacgatttttaacgcgtaattcagcactttctaaaaagatcatcactaaacgattcaaagaatctaattcatcatgagttaaatagtttttagcggtaataatatcgcctttacgtacaacagcacctttccaagaggtaagacccatattaggcaatttggcatttgcacgcgtacaaataagctctgcggcggtttgttgtgtaatggcataaatcaacttattttgtgtttctgcaaaaaacatttgagtgactttatctgttttatcgtagtcactggataatttaaataactctcgtactttttgataaaaccgcaattcactggctcgaatttcgcgaatttgttccagtaattcatcaaaatgatcaaatcgaccttgaggatttttcaaccgctctttatctaatagaaaacctttatctaaataagtacgtaattgcgtattcgcccaacgacgaaactgtacaccacgagggctgcgcacacgaaagccgatggcgagaatcatatcaagggaataatgttttacttgatattgtttgctatcttgggcagttattaagtaatccttaataactgaaaactcatctaactctttgtcttgtaatatgttttttatatgagtggttatatttggtacagaggtgtcaaaaagttccgcaagctgattttgagtcagccaagcatcattttcgacaaccaataaagcaacgtgagatttgccgtcatcggtgttgtagatgattaagtcgttcatatttactctgttatattatcagtttgtggctctttaatattataatatatatagaanccataattattaattagatgttcaagtaaatatttaacaatcttcttttcggcatctgttggttcagcgattatctcatttgataacgtagagtgactagtaaaattgattatacgagtgtaatagctttgtcttgcatcatcattgggtaatagatttgaccatcctgaataaccaagaaagttagcagttttttcatataaatttctcagtaacatgaaatgatatttttgaatatctttagatttaacttcttcaagtagattttttagaaaaagatgataggagaaactcttgtttgaaccaccttgtttcacctcaagatcaaatctttcgttttcattcttattttcatcttttcttagaatataaccattttttgctccaagttcattgtataaaacgttataaaataaaggattgtgtgtggtgataataaattttatagtatcgggactatctttgactaattctgctaaatcaacagctaattgaataagatgttttcatnccaatnaagggtaccgagccgatatcgtatac

SEQ ID NO: 477 - DNA, 3679 bp, H. influenzae
  misc_feature (1914)..(1914): n = a, c, g, or t
  misc_feature (1959)..(1959): n = a, c, g, or t
  misc_feature (2131)..(2131): n = a, c, g, or t
  misc_feature (2134)..(2134): n = a, c, g, or t
  misc_feature (3584)..(3584): n = a, c, g, or t
caaaagatgtgggtaagagaggagaaatggagaaagagtgaagggggaagtatggtgaatgaaagaaaggacgatatagaggagagataatggaagggaagggggaggacggagtaagaagaagatgggggaagagagggtgagaaggaagaagataaggaaattagaggaatgaaagaattagaagtgaaatagtgaaagataggaataaagggggagggtggataggagtgaagcgaaagaaggggagagcaaagaataacgcggagagataagaagaactgaggtaaagtcgaagccaaaaaaggcgtgaaaaacaagtaaagaacaaagcttcgcgtggaagcagaagacagctgggcatgtaggggaaagtggatcaggaaattccaaacagcttggctttaatggattattgccagccaacggttaagtgaaggctctgccattttaaagggaaaaaattagttaatttaccgaatgctgaattgaataaaatccgcgccgagcaaatttccatgatttcaaagatccaatgacgtcactcaacccatacatgaaaatcggtgaacaactcatggaagtgctgcaattgcacaagggctatgataaacaaactgccttgccgaatccgtgaaaatgttagacgcagttaaaatgccagaagctaaaaacgcatgggcatgtatccgcacgagttttctggcggtatgcgtcaacgggtgatgattgcgatggccctattatgccgtcccaaactactcattgcagatgaaccaacaaccgctttggatgtgaccgttcaagcacaaatcatgaccttgttaaatgagttaaaacacgaatttaatactgcgattattatgattacccatgatcttggggtagtggctggtatctgcgatcaagtcatggtgatgtatgctggacgaaccatggaatacggcacagcggaacaaattttctatcatccaacccatccctattccataggcttaatggatgcgattcctcgcttagacggcaatgaagaacacttggtcaccattcctggcaatccaccgaatttattgcatttgccaaaaggttgtccattctcacctcgttgccaatttgctaccgaacaatgccaaattgcgccaaaactgactacatttaatcacggtcaattacgtaattgttggttatcagcggagaaatttaacctatgacagtctcaaacaacaaagaattactccttgaagtcaatcacttaggcgtcagttttaaaattaaaaatgataaatcccttttcttcgccaaaccgcaaaccttaaaagcggtgaaggatgtgtcttttaaactttacgcaggtgaaactctcggcgtagtaggtgaatctggttgtggtaaatccacacttgcacgcgctattatcggtttagtcgaagcgagtgaaggggaaatcttgtggcttggtaaacatttacgaaaacaatcagcgaaacaatggaaagaaacgcgtaaagatattcaaatgattttccaagatccgctcgcctctctcaatccgcgaatgaatattggcgaaatcattgctgagccattaaagatctaccaaccgcacttaagtgccgccgaagtgaaagaaaaagtgcaagctatgatgttgaaagttgggcttttaccgaacttgattaaccgctacccacatgaattttctggtggtcaatgtcagcgtatcggtattgctcgtgcgttaatcattgagcccaaaatgatcatttgtgatgagcccgtttcagcgttagatgtgtcgattcaggctcaagtggtgaatttattgaaatccctgcaaaaagaaatggggctttccttaatttttatcgcccatgatttagcggtggtaaaacatatttctgaccgtttattagngatgtatttattctatgcaatggaattatgcatcgatgtggaagnatataacgataccaaacatccttataccacagccttaatgtctgctgttccgatccccgatccaaaattggaacgcaataaatccatcgaattacttgaaggtgatttgccttcgccaattaatccaccgtctggttgcgtatttcgtactcgctgtctaaaggctaataanaantgtgcgaaccaaaaacccccccttcaccagccaaacaaccaagccatttgtggcttgcttgaaagtcttataaaacaaaaagtgcggttaaaattcaccgcactttttacttttacaatcctaacttttcttcaattaccttagccaaatcatctagcatcgcataacgtttacgatacatggaacgttttttacttggaatatcatccagatttctatccatttctaaaggcaattcccagtaatcttttaattctccgcctgattcgccaaaaattgcatcataatccacagtatattgtttactttgaatgaagcgagatttattttggtatttttgcggaatgccaagcaatttatcgtagcctagtatttttgtgagtgatttcatggtttcaaccattaaataggcagggcgtaaaccgtggcataatttggttagttgtttcaccatttcctttgagccttcaaaatttggcccttgtacaacagcaataagcaacgcatcgcctaatttggcaaaggtaagcaaatagactaattcgtttcttggtttatgccatagctccaatacccaatatccttccatcggttgatgggttgtcatgcttaatgtcatttcaaaatcaggaatgacttcgccaaaacttagaggtttttcccataacggcgtagaaagtgcggtaagtttttcgggtaaaaataaaagattctcacaaacggcatgaaaacgttgtgatgcgttaaaacgcttatctaaaaaacgacaagcaacaggataactataatccaagtgcgtattaaaaatatcgacgagaaaaggatattgattgataaattgttcaaagcgacgaattgaaccacgatttaaaaagctacgtaagttataacgccaatgttttggtgcatcaaaacgccctggtcgatatggataaatatccttagattgaggccattggtaagttgtttttgttgtcatctggattgccattaattgattataatttcagagagaattttgacataatttcaggaaattttccatttatgctattctaaacacaatttttaaaaggaatacttatgtctgaaattaaacttaattaccacaaaacccactttttaacgagcgcgccgaatattcgttccattcctgaagatacgggcattgaaattgcgtttgcgggtcgttcaaatgcgggaaaatcgaccgcacttaatgcactaaccaatcaaaaaaatttagcgcgcacctcaaaaacaccggggcgcacgcaattgattaacttatttgaagtggaaccaaattgtaaattggtagatttaccgggctatggctatgccgccgtgccagagcaaatgaaaatccaatggcacaaatcccttgggcgaatatttgcaaaaacgcgaatgtttgcaagaattggtttgggttgatgggatattcgtncaccctcttaaagatcttgaccaacaaatgattgaatggggcgggttcagcaaatttaccgggaccttttattggttactaaagccgataaataa

SEQ ID NO: 478 - DNA, 5466 bp, H. influenzae
taagagaggggaaaataatttccggtgacaatcccccaccccctaaaaaaaacgccgaatatcgggaataagcaaagcgggttccccccttaatttatgaccgttttccgtaaaataaaaataaccggaaaatgcgccttctgagttaaaagaacccccattaaaaataacttaaaaaagtttgataataagaaagtgaaccatacccttctacgcccaattaccgggataaattagggcaaaagtaaaaaaaggaactaacttggccgataattccccaacaaggtaattagcactatctttaaaaactttcataaatatcaccgcacttttgatgaattcgagcgttcgtttatcaaaaaataagggggcttattttaacaaaatcaacatagacaagctatgactaatcattataatgaaactgctctacatcaaggatcttatctatgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaataatttgcttataaaactcgatgacttgttgtttgaaaagaaaattatatttgctcataaaaaaatctgcaccttagttagttgtttagtccaacttttggggtgcagatcaattcaaggcttttttattatatttcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttccacttccgccgccgttggtacacgagggctgtgaatatcgtaaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggtttgtgaggctttgtgcatattgagaccagcgtactgtcattggctctgggcgagttacatcaccgtaaatcactggtggttttacacaacgtgaaccatagctttgtacccaaccaaatttagtgaatgcgaaaccatctaataattccccaaagtattccaccatgtcgttacgttctgcttcaccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgaggttgcacgtgcatctgctgccgcttggcttgcatctaatgctgcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtaatcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagcgtaaacagatttataggcttcaacccattctgctggtaaatctaatgctaatgcaggttcatcaatttgaatccattctgccccttcagccactaatgcatttaaaatttcaacataaacaggcactaattgatttaataaatcgaaacggttaaatgcttcgcctttttctttacctaaccataagaatgttaatgggccaacaatcacaggtttgaagtttaagcctaaggcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattggcagccgcttgatgtttccagttttttcacgcaatgctttcgctaaatctaataaatcttgctctgctaattctttacgccaataacgttcttgtgcaaattttaattcacgttttgcccctacacgaggaaagcctaaaatatgtgatgttgtcataataactcccaatttaaagtaatttttttaatcatttagacggctaaacttctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcatatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgtgccaagaatactttttccaatataacgatcaagggtatttatcattttgccgatcctttcttactgaataaatagcgaaatttatacattatttcactgtcccagctattcaacaccacagcaagtaagaaaaatccgatattaacaagcggcattaaaagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgtttgtattggggtctcccagagtcgaccgcaggcagcaagctgc

SEQ ID NO: 479 - DNA, 4008 bp, H. influenzae
  misc_feature (3841)..(3841): n = a, c, g, or t
  misc_feature (3895)..(3895): n = a, c, g, or t
aaaccgcactttgttctatgagtcaaaagtgcggtaattttttgtgtgtttttatacgttgaatcggaaatgcattacatcgccatcttgcacgatgtaatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcaccgactgaaactgtccaagctcgtacttcttttacgccagcagtgaaataagtttgaagatttaaaagtgcataaccagcacgaattactcggttcaatcctggttcttcaatgcctaaatcttgtaaaaactcgactttttcttcatcgtcaagttctgcaatttcagattcaatcgcagcacatactggaacgaccactgccccttctttttcagcaatttcacgaacgcaatctaagtatggattattttcaaaaccatcttcatttacgtttgcgatatacattgttggttttaacgttaagaagttgtaactcttgattgcttgcaattcttctttatctaacccaacagaacgaatcattccagcattttcaagcacaggaaggattttttccataacggaaagttcaaatttagcttctttatcgccaccttttgcacgtttttgtaaacgttggattgctcgttcacagctgtctaagtctgctaaagctaattcagtgttgatagtttcaatatcatcaagcggatcaattttccctgcaacgtgtacaatgtcatcgttttcaaaacaacgcactacgtgacctatcgcatcggtttcacgaatattagcgaggaatttattacccaagccctcgcctttacttgctcccgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgcccacatttggcaatcccacaataccacatttgaatcccataatttttccttattttgagtaaaacggttgtaaaactaaccgcacttttaaattttaaaactgtttaaacgattggtcgctttgatcattccatctttgaaaattatttctacacaatcagttgcctcatctaacactttttcaagtgcatcgcgatctgctggagatggtttatttaaaacataacctgccactaaatcacgatgaccaggatgcccaatgccaatacgtaaacggtagaaattattgttattgcctaattgagccacaatatcttttaagccgttatgcccaccatgtccaccgccttgtttgagtttcgctgtgccagcaggcaaatctagttcatcgtgaataaccaaaatttcttcaggtttaatacggtaaaaacttgccaacgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattatggcgtgtatcggcatatttttcgccaggattgcctaaaccaacaatgagttttatttctgacatttttatttgatgatgtaaaaatttgatgatgtaaaaaatagtggcgtattgtagcgaaaaagccttaaattctcaatctataaggcggaaacaaagaggtaatttattgctcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagcttaaaaatgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtgggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaataatatgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgncgaaggattgttgctcaaaactttaagaaactctaccgcactttataaagcagnggggataataacttcttctacggtgcggcattgcaagatattttgctattctggcccgcccggatccagttaaaagtccgtttttttccactgcggttcaaggaagaggcact

SEQ ID NO: 480 - DNA, 4079 bp, H. influenzae
cttgggttaaccaggatttaagtcccttccccataaaggcggccattcatttccccccaaagactcagtagaaaactaatcggtcttccagtaaaggttaagccctccccttccaaaaatttaggtctcccccggtaatcacaacatataaatctccagctggtgcgccattatcgcctgctgcacctttaccagattagcgaagttggttgcccgtatctacgcctgcaggaatttttaatgaaagattatctttcttatgaactcgtccttctccatgacaactgcgacaaggtttttcaattttcttaccgctaccgtgacaagttggacaaatactttcagatacgaagaaaccttgctgacgacgaattcgaccagaaccgtggcaatgcggacaagtttccactttagaacctttttcagccccagagccaccacagctatcacaatgtgcaagagtattgatttgaatatctttggttgtaccttttacggcttcttctaggctaatttctaagtcataacgtaagtcttcgccacgaacaacgcgctgacgaccacgtccaccaccgaaaatatcgccaaaaatatcaccgaacatatcaccaaaatcagcaccgccaaagccgccaccgaagccaccagtgccaccaccttgttcaaaggctgcgtggccatattgatcgtaggctgcgcgtttttgatcgtcgcctaatacttcataagcttcattaatttctttgaatttttcttctgcttctttactgccttggtttttatcgggatgatgtttagacgctaaacgtttatacgcacgtttgatgtcgtcctcactcgcccctttttgtaggccaaggacttcgtagtaatctttttttgccatagtaattttgtaatttgttgctgaaaataaatacaccaaaagggcgtgtttccacgccctttgtttatgctaagaagagcggtgaattatttattatctttcacttcttcaaattcagcatctaccacgccatcatcttttgctgatgattgttgtggttgctcgccaccagcttgttgagcttttgcttgcactgcttgcattaatggttcagaggctttaattaccgcttcaatttttgcttcaatttctgctttatcttcgccttttgctgctgtttcaagctcagcgactgcagcttcaattttctctttgtctgcgacactcaatgcatcgccagcttctgcaatttgtttacgtgttgcgtgagcaataccatctgcttggttacgagcttgaacaacttcttcaaatttacggtctgcatcagcatttgcttctgcatcacgcaccatttgttgaatttcttcatcagataaaccagatgatgcttgaatacgaatttgttgctctttacccgtatttttatcttttgctgatacgttgattacgccgtttgcatcgatatcaaatgttacttcaatttgtggcataccacgcggtgcaggattaataccttctagattgaattgacctaaagatttattgtctgccgcacgtttacgttcaccttgaagaacgtgaatagttaccgcactttggttatcttctgctgttgagaatacttgcgattttttagttggaatagtggtatttttctcaattaaagtggtcatcacaccgcccatggtttcgatacctaaagataatggagttacgtctaataaaagaacatctttcacatcaccttttaatacaccaccttgaactgccgcaccgattgccaccgcttcatcagggtttacatctttacgcgcttctttaccaaagaactcagcaactttttgttgtacaagtggcatacgagtttggccacccacatgaataatatcgtggatttcgcttacacctttatctgcatcttttaataccgctttcactagactcaattgagcttgccactaaatcttctactaatgcttctaattttgcacgagtgatatttaatgctaagtgtttaggacctgtcgcatctgcagtgatgtacggaaggttcacttcagtagattgagctgatgaaagttcaatttttgctttctctgcagcttctttcacacgttgtaatgccattgcatcattacgtaaatcgatattttgttcttttttgaactcatcaataatgtaatcaattacacggttatcaaagtcttcaccacctaagtgagtgttaccaccggttgccaatacttcgaaagtttgttcgccatcaaagttatcaatttcgatgattgaaatatcaaatgtaccaccacctaagtcataaacagcgatcacttggttctctttgcttgaacctaaaccaaacgctaacgcagccgctgttggttcattaatgatacgtttaacatctaaacctgcgattttacctgcatcaatcgttgcttgacgttgtgcgtcgttgaagtatgcaggcacagtaattactgcttcagttacagattcacccaagaaatcttctgcagtttttttcatttttttcaacacttctgctgaaatttgcggtggggctaatttatcacctttcacgtttacccaagcatcgccattgtcggcacgagtaatttcgaaaggcataattttaatatcgcgttgaacttcttcactttcaaaacgacgaccaattaaacgtttaatcgcaaacaatgtattttttgggttagtgattgcttgacgttttgctggctgaccaactaaggtttcattatctgtatatgcaatgattgacggagtagtacgtgccccttctgcattttcaattacgcgcgctttatcgccgtccattacagctacacaagagtttgttgtacctaagtcaataccaataatttttcccattttgtactcctagtaaaaattttaaaattcggggtagggcttttagacctatttattacgaattgtaagatgtggatattctttcgcatttcaagagaaaattttaaaaattttttatttcttaaagtgcggtaatttccgttcttgtttttcaaaataagtctcaaatgatgaagttcaaagggaaaacaaaaattttcaggcaagaaaaagggatttgtgataaatttggcgaaaatttttactttaaaataggaaagaaataaatgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaatccaaccgggtaccgagtccgaatcgtaaaca

SEQ ID NO: 481 - DNA, 3730 bp, H. influenzae
ttgttggttataatagagcatttccctatataaaacagaaaaaatccgcctgggttgtaatttttaaggagaagaaaaaattgcaaccagtttcagcaaataagtgcgttggggggcgttaatcgttgctattcttcctcatttatgaaaaaagtctcaccagcttatggtatgttggtgggagctttggttggagggttaattggtggtgcggatttatcgcaaacagtgagcctaatgatcggtggcgcacagggtattactactgcagttatgcgtatcttagctgctggtgtgttggcaggcgtgctgattgaatcgggtgcagcaaattccatcgcggaaaccattactaataaattgggtgaaactcgagctttactcgccttggcactagcgacgatgattttaactgcggtgggtgtgttcgtggatgtggcagtgattactgtttcaccaattgctttagcgttatcgcgtcgcagcgatttatcgaaagctgcaattttgctcgccatgattggcggtggtaaagctggtaatattatgtcgccaaacccaaatgccattgcggcagcagatacttttcatttgccactcacttcagtgatgatggctggtataattcccgcgctatttggtttgattctcacctacttcttagcaaaacgcttaatcaacaaaggttctaaagtgactgacaaagaggtaatcgtgcttgaaacgcaaaatttaccttcatttctgaccgcacttgtcgcacctttagtggcaattttgctattggcacttcgtccattgtttgatattaaagttgatccattaattgcattgccgttaggtggtttgattggtgcgctttgtatgggcaaacttcgcaatataaatagttatgctatcaatggattgagtaaaatgacacccgtggcaattatgttacttggtacaggcgcgcttgctggcatcattgctaattctggtttaaaagaagtattgattcaaggtttggaacattcaggtttgccatcatacattcttgcaccaatttcaggggtgttgatgtctttagcgacagcttctaccacggcaggtactgcggtggcatccaatgtgttcagtagtaccttgttagaacttggagttagcagtcttgctggtgcagcaatgattcatgcaggggcgaccgtatttgatcatatgccacatggttctttcttccatgccacaggcggtagtgtgaatatggatatcaaagaacgtttaaaacttattccttatgaaagtgcggtcggtttgatgatgaccatcgtttctaccttaatttttggcgtatttaaattctaggagttgttatgaaatttgtgattgcacctgattcttttaaagaaagtttgaccgcacttgaagtcgctaccgccattgaaacaggcttcaaacgtgtattccccgatgcggactatgtaaaattgccaatggcagatgggggcgaaggtacagttcaatcccttgtggatgccacgcaaggcaagctcattgaatgtgaagtcaccgcgcctttgggtgacaaagtgaaaagtttcttcggtttatcgggagatggaaaaaccgcgattatcgaaatggcagcagcttctggtttacatcttgttccgcctgaaaaacgcaatcccttgcttaccaccagttacggcacaggggagttgattaaattggcattagatttaggcgtagagagtttcattcttggcattggcggtagcgcaaccaacgatggtggtgtaggaatgttgcaagctctagggatgcaatgtttagattcgcaagataagcctatcggttttggtggagcagagctagcaaatattgtgaagattgacgttcaacaattagatccacgtttgcaacaagttcacattgaagtagcgtgcgatgtgaataatccgctctgtggtgaatgtggtgcatctgccatttttggaccacaaaaaggcgcaacgcctgaaatggtgaaacaacttgatgctgcactttcgcattttgctgaaattgccgaacgcgattgcggtaaacaaattcgtgatcaggctggcgcaggtgctgctggtggtatgggtggtggcttgctattattaccaagcgtacaactgaaagcaggcatacaaattgtgttagagcggttacatttaattgaccatgtaaaagatgctgatgtagtgattacgggtgaagggcgaatagatgcacaaagtattatgggtaaaacgccaattggtgtggcacgtacggcaaaacagttcaataagccagtgatcgccatcgcagggtgtttgcgtgaagattatgatgtggtgtttgatcacggtattgatgcggtgttccctattattcaccaacttggcgatttatcggatattctcaaacaaggcgaacaaaatttaatttctaccgctcaaaatgtggcgagagtactggcatttaaatttcattaagaaataaggcttgttttaaattcgagccttattccatgattatttattttgtgatgttgaataatttctcgcaccaaaaatcgcagtgccaatgcgtaccattgtagaaccgcattttattgcgctcggcatatcatccgtcattcccatagaaagtgtatcaatttgttgattgggtaaggcttgtttcagttgttcaaataggtctgacatttttctgaacacggcttcttgttcagcgattttatcggttggtgcgggtattgccattaagccacgtaggcataagtgcggtaaattttcgatgtgttttgctagtgttagcatttcctcaggttgaatacctgatttactttcttcatcgctgatattaatctgaattaatacattcaatggagccttgttggtcggtcgttgttcatttaaacgatctgcaatttttgctcgatcaagcgtttgcatccaatcaaaatgttctgcaacgagacgggttttattcgattgtaatgggccgataaaatgccattcaaggttaactccttgcgattcaaaatattggatcttttctaccccctcttgcacgtaattttccccaaaagccgtttgtcccgcttgataagctgaaagaatctcggaaataggtttggtcttagatacggcaagtaattttacggtattttgattgcgattttcttctttacaagccgtttcaattttttgctgaattaggttgagattatgctggatattcataggttttcctttataaaaaagtgcggttagtttacacgaaatttattgactaagaaaatttctgaaaaatttgtcactttctgtttgacaagctcgggaaatttcggtatttctttacgcattcatttttcaagataaaacacaatgaaaaataaccgcactttatccgtaatcattagcacgattaccgccattatgatgaccattattatgattaatggcgcgggttagtgcagcaaaaacaagatacagaaaacccgcgattcaactgaatagcgggtttttttataaatttaaaaacacaatatctaggagaaccaattatgcgcgtacttaaatttggcggcacttcgcttgcaaatccggaacgtttttcccaagcggcgaaattgatcgaacaagctctttagaagagcaggctgcaggtgttttatctgcaccagccaaaataaccaacctgggtaccgagtccgatattcgtataccag

SEQ ID NO: 482 - DNA, 4441 bp, H. influenzae
  misc_feature (4411)..(4411): n = a, c, g, or t
caaaattcttttcataaggcataattaaaccaatttcgcccgcataatcaggatgtgtaaagactttagcagggccatccgtgtgggatttatgctgtaatgtccaaccatttttcagcaatttatccgctaagatttgtccagaaagatggtatctatcaaagaaactatccatttcgcccgtttgcatcaactcaataaagcgcatttgaattgggcgatgttttacccaagcaaggaattgctcaaactctttgtcattcagatttttcattaaaactgaattaactttgactttattgtaacccacttcaaatgcacgatcgataccacgcatcacgtcatcaaatttattgatacctgtaatttgatggaacattttcggatcaaggctatcaacactaacgttaatagacgtaatccctgcttgcttccaatcagccacatcttttgccatgcgatagccgtttgtcgtgacggctaattgacgaatgccatcaatgttagcaatgctttcggcaatagaaataaaatctttgcgtaaagtcggttcgccacccgttaaacggattttctctgtgcccatttcagcaaacgcttgagcaagatggataatttcttttaaggttaagaaacttggtttgttagcttcgggttgataaccatcaggtaaacaataggtacaacgaaaattacactgatcagtaatcgacagtcgtagatagtaatattgacgttggaaaggatcgactaagcgagactctcctacgttcttgataggaatggattgcattttacacctttctaaatatggagaggataaaccgtttccagcgtatccctgaataacacacggcgttattggcttgccaccgtatttcttctgaaacttaggctaaacaagctcggagttatgcgttaaatttgatttgtcgtcattctaaaagattcacttcataaacacaatcaataatattgatgaaaatcagtattttcctaaattcttaaaaatcaattatataaaaaaatacataatgaatttaaagctggctcattagtgataattaatcctatttatattaataaccataaatttttagctgattattatgaggtatttttattgatttaaatcataatttaatcaataaataaatttctctacttttcataatcagaaaaatatcctaccatttttatcggatttatttttactaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtgtaatggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaataattcaatattcatcaaaaaataaccgcactttaatctattccgaaaaacaaactaaagtgcggtcatttctataaaaattttgagttggtcgataagccgagttctgtcgtggacaatcattcctctaggcaacaaattactctgccgctcaagcaacctacccgaactctggacgggccacccattgagttcctatttggtcttgctacgagtggagtttaccctgctgccaaccgttaccggaggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttataaacaataatgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagctaaggaatcccaatgcaacaaaaattagaaaatattaaatttgtcattactgatgtagatggcgtgctcaccgatggacaacttcattatgacgccaatggcgaagccatcaaaagttttcacgtgcgcgatggtttaggcataaaaatgctgatggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaataataactcattcgtcagtgttattgcttagtaaaacgaagtaaccgcaaatattgcctatttaaattaactgtttaaatatacaatgcaatagaaataaatcaagatttttgtgatgacaaacaacaattacaacagcttctttgcaatctatatgcaaatattttaaaaaaatagtataaatccgccatataaaatggtataatctttcatctttcatctttcatctttcatctttcatctttcatctttcatctttcatctttcatctttcatctttcatctttcatctttcatctttcatctttcatctttcacatgaaatgatgaaccgagggaagggagggaggggcaagaatgaagagggagctgaatgaacgcaaatgataaagtaatttaattgtncaagggtaccgagtccgatttcgtatacag

SEQ ID NO: 483 - DNA, 5174 bp, H. influenzae
gagaccccctatggtcagtagggcttttaacccctgtcagcattcagggttaaaagccctgaccgacaggaaaaagtatagataaaagagctgttgatttcaacagctttttgcttttaggtatgaattaatatccagtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaagggcggggttttattagatgcgattgcatttaatattaatacaagattgtatcctgatctttcaattaaacaggctcgtttagcctataaattagatattaacgaatttcgtggcaatcgtagcctacaattattggtagattatattgagccgatagatgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaatgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcgtaataatcttttaataagataataaatgctaaaattgaaggcatagctattagctatgcctttttatatgaacctattagaatttatagtttaaactcagaatataagttcttccacgtgcaaagttataaagcacggttttatcttttcctccatcttcacaatcctgacttttactacaaattgaatcatttaaacttgaataataacgttgcgaagccgcatcatttccagcatctaacggatcaacataacgtttatctaatagattttgtacttccgctttaataatcaaatctttgattggttcatagctgacgtgtaaatctaaaataatcggttgttttttaatctcttctgtttttttcacaacgtagtaagttcttttacctgaggtctttaattcaaagtgagatccattgatatattcttcttcaattgtcgcacgtttactttttccataataacgagctgccatacctaaggttaatttttgatcaaaccaacgtgtaccaatctctaatctgccgtagtcttttggtagcattgaaacacgagataagccataaccttgtttcaaaatgtcttcttttgaagcattattcggacgtgagctggcatcggcataattggttggctgattagtacgttgataagcgtaagagacattcgcaaaaaaacgtcccatatcataattaagctctaactccgccccgctttttttcacgataggttgataattttgatgtgcgatagtaaagcgaaaaccagtactgtctgcccacgtaggtacaacgccatctcgccaccaaacaccgtaaacattatggatatagtttttaataaagctacgataacccactaatttgatgcctagcacatcgtcttgagtgaagagaccttttttataagtattaaagcctagttgataggtatcagattgttcaggttttaatgccgtgtttacccctgcattagacacttgagagaaaaacatctcttgaatattcggcattctgtgtgtgcgtgaataagtgaaaaatggcataaaataatcgcttagctctgcacttaatgtagcggaatgattgaatgcctttttatgccctgatttatgcaaaatcggttcattaatttgattcgctgtattttcatatccaacatactcaccattaaacgcataatgggtaaaattcacgctgtaatttaaatggtaaatacctttagaaagtgcggtatcaaaatacaccgttttaaatttttgcttgccagaaggttgtaaaatcactgaacgttgtggcagtaaattacgattacctctaaatcgtcctaaattactatagttaccttgatcatgtgaatcatcgttataaaacaaacttaattcttctggaaaacggtttttactgtattcattggtaaaatagttaaaacctaatgtggtttttaaatcgatttcttttggcaacaagaaagtatggctgttgtttatatcaacaatatttgccacatttttggtaataagtttgtctgccactcgccagccagcaaaaaaaccacccttaggataaatggttttaccaatgttatgtgcagccattaaattaagatcgagatagttgttattattgaagttataattgacttggtaattacggttttcaattttgcgagaaccaattttattatccaatgtacgtatttgtgctcctaaattttggtgatcatcgccatattcaaattttaataaatggctacgcgagcgtgattgcaaactaccaggctcaattggtgcaacactatattgatctttattacgttcaaatgatttgtcagtttctttaattccatccttaccgttttggagctcgtcaatattctcaggttttgttccagggtaccgagtctgatattcgataaca

SEQ ID NO: 484 - DNA, 3662 bp, H. influenzae
  misc_feature (46)..(46): n = a, c, g, or t
  misc_feature (3624)..(3624): n = a, c, g, or t
  misc_feature (3648)..(3648): n = a, c, g, or t
gccagacttggcatgcctggcaggtcgactctaggaggacccctgnagcatctttaaattggcaggcattacaacctgatttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacaggttactgcgttcattttaaaatagaatatttcagttataactgggatttatcatatataaaggattctgaaaatgcaaagcacttggacacttaataaaaaaaaatagctattcttatgatgatttgctcgcatcaggtcgcggcgaattatcgggtaaagaaggggccgcaattacccgcgcccaccaatgttgatgatggatcgtatagttgaaatgaatgaagaaacaggtgctttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattttaatttttctttattaatttatataaaagtgcggtgaaaatttttcttagattttcaccgcatttttccttattaaattgtaataaattcttaaaatatctataatattcttgctattttttcaattttattagtagtaaataaaatttattttaaagctttttaatagacgttattatagaaaataataaattaatttctatttaaactataaataatatactgaagtagtgggaatatgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaatgatgaagaaaatattttttatttttgtattatcaggcatattagctgcttgtgccatgggtggtggtattcgtgctggtggtggaagtaatggtgtaggattaggtgtggggattggatctggcattcgcttctaataatgaaaagtgcggcaagtttgatctttatnctgccatgggtaccgaaggcccgntattcgtataccag

SEQ ID NO: 485 - DNA, 5986 bp, H. influenzae
  misc_feature (57)..(57): n = a, c, g, or t
  misc_feature (958)..(958): n = a, c, g, or t
tgtttacgattcggactcggtacccatcaaaagttgtaccattttttttccttgttnatttgagaaatttttttgagaatataattgagaatgaatttcaatcactcggggaattctagcaaaggctgaataatgcgtaaaccttgaatttaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagtgcttttttctcaataaattgagctaattttttcggggcatcaggactaataccaagtacaactaagcctagtgcatctaattcagatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactatacaagtgaaaccaaatataaaataaaaacgcacggaggtatatgtcagcgcaaaatcctttatttcgggtagcatagttgcccttgttacgccaaatgaatcattatggcgaagtcgatttttcctgtttagaaaaattagtagaacatcacattgaagctggttctaatgcgcttgtttctgtgggtacaacgggagaatccgccacgctaagtattgaaganaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataaagtactttaattcaatagggcgtgtcatataataatttctctaaaataataaatatttaaacatgagacatagatcatccttttgaaaattactctgatatttatctttaaaacacttgaaaatctaacataagaacactattttgttattaactagaatttaaatcacgcaacaaagaggtaaatgctatgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaactaaatactgtagataaaatctaatctggcagtcttattgtaaaatgatatgtctgtcagattaattttagatgaaacaattaaatcactaaaaattgatgatatttaataaaatattaataatattttattaaatatagattaatttaacctatcgtgcaaggcgatgtaaacttcagtacattcacgcttatccactacaagaacataaacgacaactttatcttcaataacttcataaacttaaacaatgccctacagagcgaaattttattttataaaacacaccaaaaaatccagaaaaccgatcggcaaatacgtatgaatttcctaagcgtttgattaattttttcttaaattgcttttaataaaaatagagactaatgaaagatacagattaaatttatattttttaacgagatagatattatttgacgggattaatggcggtgagaaagggatttgaacccttgatgcagtttcccacatacacgctttccaggcgtgctccttcaaccactcggacatctcaccgtaaaaggttcgcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgatttttaataaataccatatattaatttatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgtgtaataaatttttctttttaatcaaacctcgatccgttggtgtaaaattaaatctattattaataaattttacttttcctttacagataccatttagaatatcttgatcttggtatttcataacattattgtatttattcatccaatttattgatttttggaaaatattttcttctttccatttatttaaattaattaataatatacctgcattaaaataagaatatccttctaaaccaatggattttttataagcttcattttttacatcaataaaagtatctcgacatcctgccaaataatagttcattatatctatattccaaagttcttgaagtgaagagtttgttaatgtgtccacatcaatataaatagctttttctatattctttatatatttagttaaatttagtctagcgtaagtcgctaaagatatgtaatctattgtttttggaaagttttgaaaatctgcctcactgacaggcaagaaaaatactttacaaaaatatgcagttgctaaattatttattattgtcttattttcctgatttattttcatatcaagaatataaaaatttattttttcaggtgtatttttaataatgctaaaaatacttacagctaaataaggtgcataatggttgtcagatgaaaatataatatttattgtctgtctgtctgtctgtctgtctgtctgtctgtctgtcataaaattatcttctgattaacgtgtaaattattattttttattaatagattaaatacttttattaactttataatttattttttaaaatattcaatgcctttgctcgatgagaaatttttttcttctcagctgtttctaattcagcaaatgtgcaaccttgttctggactaaagaataaactgtcataaccaaaaccattttcgcctttttcttcaaaaccaatcacgccacaacactcgccttcggctataattggcgatggatctgttggatgctgtaaaaacacgatacagctcacaaatttagcttggcgttgatcttttgcaacatgagcaagctctgccaataatttctcacggtttttagcatcattgccctcttcaccagcataacgagcagaatacagacctggtgcgccattaagtgcggaaaccaccaagcctgaatcatccgcaatagcaggtaaacctgatttttctgatgcataacgtgcttttaataacgcattctcaacgaaagttaagcctgtttcttctgggctttcaatgcctaaatctgtttgcgcaatcacttcaaagccaaaatcagataggacatcagccatttctttcactttgcctttattgcctgtagcaagtacgattttttgtttcataattagtccttttattgatgataagctgccgttaaatcagcccagttttgctcggtaaattgaatattcattcgtccaacttctttttcaaaggaacgttttaaacggttcagattttgtgctttccaaaaatcccctgattttttaccgcacttatcaaaatcaatcaaccaacatttttgctcttgttcagcttgttgaagcaaaatattgtgtgcattcaagtcagtatgacaaatctgtaaatcatgtagttttcgaatcaaacgaccaatttgcctccaagtttcttttggcaatgtttgtgtttgtaaaagtgcggttaaatcctgcgcgttttcgattttctcagtcaaaatatccgcttgatagcaaatacctaacttgcctttttgaatacgcgcggcaatgggtttaggcacaggtaaaccccgcttcatacaaacgttgcaacaaatgaaactcagcaaaactacgggtagtttcaagaacagaaaaaccataccgatcttcgctcactcaaccccatattccaccgcgatatttatgaccccacgtccaagttaatcctcaacccattccttccgtcttttattcactttcccgtccccctatttccttgttcttttttttcccgccacctgttcccgtcccacccttgcttccctccatctccgtatttctttcttccgtgttttctcccttccccttattttccgcgattttctttccgtcttgtttacccccacccccg

SEQ ID NO: 486 - DNA, 4093 bp, H. influenzae
gggggagtgtatagggtgtgcatggtgctgagatagtgatgggattgcgaaaagtagcggggtaaattcacgtatcataaaaatcgagatcaccgaaaaaaggccgggtcgtcaaagaaggaaaggaatgagttgtgttgtattgttgaacagtaagatgggatccaacggcggggctgtggattgggaggcagggtgtgtcgtggcataattcggtcagaggcaatgcacttaacatgctagtgcaattcaaatcgcaattaaggtagcactccgccgggtcgggtggtgcgccaataaataacaaaccggcggggtgccttttcgatatgccggtggatggtgggggcaccgtcgctccttcaggagttggggtagtggatatccatcactaactctcctttatcattcggcactaaatttggccctttttcatacatatagctaacaaatgggctatttgatacaaagtgggcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaatataaaggtaaataacggagaaatttgaaaagttttactaattaaaataaaatttgattttcccattttaagcctatttattatctttaaatcacatttaaataatctttacacaactaccttatgatattaaaatttacaaaatttaagcaaatcctccacatcttctaaccaaagatttccaatttcatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgtttttttccaagtgtttctatcagcgctaaatcaaactgttctgaaagctcattatcatcattcatttctataatagattcgctttcatctgcaaaaaattgctgtagacaatggtgtaaatccttaattgaaatgggtttacgtaatacgccatccatgcccatttctaaatattcttgctcgctttgcataacattcgcggtaaaagcaatcattggcggtaaaaaatcataaataccgttttcatagttctctcgcaaatattgggcaatttcaaaaccactcatatctggtaatttaatatcgagcaatagaatgtcgtaaacatttttctcaaataaagtaatcgcctgcttgccatttgtcgcaacatcaacatgatgcccaagtttttctaaaatagtttttgcaaccataatattgagatcaacatcttccactaaaagaatattcaaggatggtatatttttcttaacagattctttttcagaaatttcctgagcgtggagagtaagatggaaagtcgcgccttttcctcgctcactttcaactgttaaatccccttccattaactgagcgagatttttagaaatagccaacccaataccgctacccgcactttgctgacggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcggggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatttgactaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttacagaacgaaaaatatctacccaagatatctgatgaacaataaatagactaaataaaatctgagtacaaagggctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaacctgtgcatataggctttattatatccataaagtaaaagagattgttattactatgtgtgcgtaagaaatgaaaaacttaatctttattaattatctgtttgactaaaatttgtaattcaggaataacttgctcttcaaaccaaggattctttgttgcccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccatgggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggcgccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgagtaaattcccaaaagctaaaaccccatatctttcgacacggggttcttctgtttttatttaacttagataagcatttgataacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcattttctggcaagttcg

SEQ ID NO: 487 - DNA, 4643 bp, H. influenzae
  misc_feature (4615)..(4615): n = a, c, g, or t
caattcatcgtggcacgattcaaggctgtggcgtaacctctattggcaataacaatttattaatggtgaatgttcacgttgcacacgattgccaaattaaaaataactgtattctggcaaacaatgcaacgcttgcaggtcacgtagaattagatgatttcgtgattgttggcggtatgtcagcgattcatcaatttgtgattgttggtgcacacgttatgttaggcggtggttctatggtaagccaagatgtaccaccttatgttatggcgcaaggcaaccacgcccgtccatttggcgtaaacttagagggtttgaaacgtcgtggttttgataaaccaaccatgcacacaatccgtaacatttataaaatgctctatcgtggcggtaaaacacttgaagaagtgttaccagaaattgagcaaattgcggaaaccgattcagcgatcagtttttttgttgaatttttcaaacgttcaactcgcggaattattcgttaataaaacttcttcattttcaaccgcactttgcacaccaaagtgcggttattttttaggataaatttgatgaacaaaacaaatccaaccattgctcttgttgcaggagaagtatctggtgatattctcggtgctggtttaattcgccagctcaaagcacattatcctaatgctcgctttattggtattgcaggcacaagaatgttggctgaaggctgtaaaacgctcgtcgatatggaagagctttctgttatgggtttggctgaaatcttgaaacatcttcctcgtttgctgaaaattcgtaaaaatgtcattcaaactatgttgcaagaaaaacctgatgtttacatcggcattgatgcgcctgattttaatttggatgtagaactcaagctcaaagctaacggaattaaaaccattcattacgtgagcccctctgtatgggcatggcgtcaaaatcgtatccataaaattgccaaagcgacccatcaagttcttgcctttttgccttttgagaaagccttttacgataaatttaatgtcccttgccgttttattggacacacaatggcagatgctattccgctcaaaccaaaccgtgccgaagcatgccaaatgctacagattgatcccgcacaacgctatttagctatcctagttggaagccgtggttcagaggtggaatttctggctgagcctttcttaaaaacagctttattgttaaaagaacaatttcctgatttacaattccttgttcctttggtgaacgaaaaacgacgaattcaatttgaagccattaaagctaaaattgcgccaaatctagacctgcatttaattgacggcaatgcacgacaagcaatgattgcagctgatgcaacacttcttgcttcaggaacagcagcacttgaagcaatgctttgtaaatccccaatggtggtaggctatcgaatgaaaccactgacctatttcttagcaaaacgtttagtgaaaaccgattatatttctttaccaaatttgcttgcgaatgaaatgctcgtgcctgaaatgattcaagaagaatgcacgccagaattgctcgctgaaaaattatctgcttatctttctgatgatgaaagtgcggtaaaaaatcgccatattttaattcagcacttcacggatttacaccaaaagattcaatgcaatgccgataagcaagcggctcaagcagtcattgatttattagaaggaacagaaaatgtttgaatatccacaaggctatgaattgatcgctggtgttgatgaagttgggcgaggccctttagttggggctgttgtcacggctgccgttattttggatccgaataatccaattgaaggactcgctgattctaaaaaactttctgagaaaaaacgtttagcccttgctgaagaaatcaaagaaaaagcccttgcttgggcattaggtcgagctgaagctaacgaaattgacgagataaatatcctgcaagcctccttgctggcaatgactcgagcagtaaaatctttaaaaattcaaccgcactttgtgttggttgatggcaataagatcccaaaagatttagctattccagcgcaagccgtcgtcaaaggcgataaccttgtggcagaaatcagtgcagcctctattttggcgaaagtggcacgagaccaagaaatggaagaattagacaagcaatatccagaatacgcttttgcccagcataaaggctatccgaccaaattacatttggaaaaattagctgaacttggtgcgttaccgcaacatcgtcgtagctttgccccagtgaaaaaagcactagaacagttttagaatgctaatttggtttaacaaaggctgtgttttaatactgtgttaatgctttcactaaaatttgatgcacataaacaaaattttttgacttctgtgagtcaaagaaaacaggttaagagagtaattaaacctgtacggtcgataaatatacctaaacactctgctattcctttgtaatagcacattaaaataatgacttatgaggatttataacgatgaagacagacattcaaaccgaattaacccaagccctactatcacacgaaaaagtatgggcgaacgaagaaaaaaccattttagccaaaaacattctgttggatttggtagaaaaaaccgacccgactattatcgggttgttattggggaatgatgagttaaaacgccatttttttgtggaagtgaatggtgttttggtgtttaaattgcaggattttcgttttttcttggacaaacacagaatcaataattcctacacaaaatacgccaatcgcattggcttgacggacggcaaccgctttttgaaagacagttcggatattgtgttggattttccgtttaaagattgtgtgctaaatggcggacaaagcaccgaagaaggcgaagaaatttattttaaacgcaataacagccagccagccaattatacactaaattaacccgaaaaagacaagaaatcttttttaatcaaacccttgcttttgatgaaattgaccgactttttgacgcaaaagcattctcaaaattctctcgctataccgcagatggcaagcaacccgttggcgaaatcaaacgccattttgacggcacgccagccgaaaatctcattatcaaaggcaataatctgatagccctgcattcgcttgccaagcagtttaaaggcaaaatcaagctgatttatattgatccgccatataacacgggcaatgacggtttcaaatacaacgacaaatttaatcattccacttggctcacttttatgaaaaatcggctggaaattgcgaaaacattgttggctgatgatggcgtgatttttgttcaatgtgatgacaatgaacaagcctatttgaaaattttaatggacgaagtttttggtcgtgaaaattttgttacaaccattcattgccaaatgtccacaacgcaaggaatgaaagttaaagcggcacaagatggaaatattgttaaaaatgctgaatatattatagttttttcaaaaaatggacataaaaatattgcaataaatcccttgtatgatttgcgttcagaatatgatgaacactattcgctatatttaaaaaacgatggggctattgggcaacttaaagaattatatgattatagatttccaaaagatttaaaaaatacaaccgcactttctttaaaagaagcatttaagaaaagtaatgaatttgccgagattgtgaaaacacatctttccaagattgtaagaagcgataaagttactggatttgatttatccgttgaattagaaaatagcaaatggaaagaagttgagagaaatggaagaaaatatattcttacattagataaaaatggcaaagtttgccaattattaagactacaagattcttggggaaaaactgataattacaataatgatgagggacttcgtaaaattcgtggtaattggtgggaaggtttttaccttgatatgggaaatgttggaaaagaagggagcgtagattttaaaaatggcaaaaaaggagagcgtttaatttcacaaattattaaaacagcaaccaacgaaaacgacatcgtcctagactaccatttaggcagtggcacaaccgccgccgtcgctcataaaatgaaccgccaatacatcggtattgaacaaatggattatattgaaacgcttgccgttgaacgcttgaaaaaagtgattgaaggcgagcaaggcggtatttccaaagccgtgaattggcaaggcggtggcgagtttgtttatgccgaacttgctccatttaacgaaacagcaaaacaacaaattttggcgtgcgaaaattcaaacgacatcaaaacgctgtttaatgaattatgcgaacgctatttcttgaaatacaatgtaagcgtgaatgaatttagtcaaatcattgaagaacctgaatttcaaaccttaccacttgacgaacaaaaacaaatgatgcttgaaatgttggatttaaatcaaatgtatgtttcattatccgaaatggacgatgaacaatttgcaggttgcttaaacgatgacgataaagcgttaagccgtgcgttctatcaatcagtaaaaaancagggtaccgagtcgatattcgaaaaca

SEQ ID NO: 488 - DNA, 3809 bp, H. influenzae
gatatcccctcattaaaaaggacaatgcaatgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttctaatcatcaaaaaatacgaaaggcagacagttttgtctgcctttattttattaggtatgcgaatttagacgtaccaatgaaaatataatcaacaaagtgcggtaaagattctatgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaattctgtcgattcagctacaatgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaatagacctagaataactaggtctagtttattcgatttaatggaatacaaattccaaaatgcacatataggctgcaatacaaaataaaataatcgccaataattttcttgttaaaactggattcattaatccacgcaatttcattgagaagaaactcattccaaatgaacccaaggtaacgacaccaactacaagaaagtttacatatcctagttggccacttaggctgatatcatagggaaaagctctagtgagatagccgtatagattaccaataccaccaataatcatcatatagttcgtataaacggcaatttgttgcgtttttaccccctttaattgcccgacaaggggcgcaagaatagaaccgcctccaatacctgtaatacccgcaattaagcctcctccacaaaaactaatactacctttagctcgttctataggagacatattaaacacttctatttgtattctcgatctgttcaaaaatgttttaatcgctagtgcacttaaactaaccgtaaaaattaaactaattatcgctgtagaaaaataaaaacttaattcaaaaccaatttgcaccccaatcaccatagcaatagaccataaaatcatattgatataatcaattttaattttttgcttatggaaaaataataaattaatcaatgcggtacacatcacaatggtgagtgacgtagctgaaataacttgaatcggtaacgcaggaaacaatgtacgtaaaattggcaccatcaataccccaccgccaataccaaaaatagcagaaaccatattggtacaaataccgcaaatcagtaagataaaaattgtactaaacgccatcttagatcctatttaaaaattcatttaatcatacttcattttgacgtaagagcatatgcgcaacttatgatcgctatcatatacagttaaaattattctgctatgataaaaagaataaggaggatacgtagatatgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttttaattaatatttttgatgaatggtatgccaatgatgtcggcaaaattggtattcaatttattgaacaatggtttatggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaataatatttatctagttcaaaattttgttaaacacttcacattttcataatttgcttatagaagaaaaatatagaaatttgtatagtaatctaaagttattgatatattaaaagacgcctttatgtttacattgtcctattatctaccacaaaacttaaataaatgtattatatctgagagtaaaactctagaaaaaaacagcttaatttatgcacaaggcgagaagcactaaagaattttatttataa

SEQ ID NO: 489 - DNA, 4831 bp, H. influenzae
  misc_feature (4818)..(4818): n = a, c, g, or t
actttatgaagcattctttgcggatcaagataaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttatacgcccctattgtcttccccaacttatggggaagatagcacgacataacgaattaggatactttcctcagtctttgatagtctcccctgataaacagggaaagctaaataaatgataagttctatttaaaggataaataaaatggcatacactactttttcccaaaataaaaacgatcaattaaaagaaccgatgttctttggtcaaaacggttatgttgcgcgttacgatcaacaaaatacgagacttttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctctaattaaaaacacataaaaaactaaccgcactttggaatattctttttaaatatttaaagtgcggttaattttttattcattttaaaaggctttctaacacagaaagccttttatttcttagatttctaataacaatcttgttggatcttccaataattctttaatcgttaccaagaaaccaacagattcacggccgtcaattaaacgatgatcgtaagataaagcaaggtacatcataggatgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattcacttcaggataacgttttaatgcttccacaaccgctttaatataaaaagacataaagcctaaacggacaccatactgtttttcaaatttttcgccgtaggttttacgcaaagtcattatcggctgcatatccacttcattgaaagtagtaagcattgctgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattgcagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgtcattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtacatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactggcggcgcaacatatggtacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaaagtttttggatctgttgttgcgtagccatattcaaaagcaagaacagattcttcagaaagtaccgaatcccatacttcaaaacgaccttgattggcgtgtaaatgtgttaatggtacataccccgtaccatcttttgatgggtaccgagtcngatattcgataac

SEQ ID NO: 490 - DNA, 5729 bp, H. influenzae
  misc_feature (5680)..(5680): n = a, c, g, or t
cgggtctcgggtaccccaagtatcccaattaaaatctcaattaattgttcaagttggaaatcagattctgtggtgattttaatcgtttcatttttttcatttaattcaattaccgcttcgacaccacgaaaatcataacgcgtgctaagcacacggtttgcattttccactgcattacgaacttcgtgtaaagtaatttcagaaacaatatcaaaagatggcatagtcttctcccattttattaaattcgatcattggcacttagaaggcataaaagtgcggttaagtcggcgaagtttaccacaatttgcgcttgttgttgcactttaggtttagcatggaacgcaacacctagtcccgccacattcatcattgccaagtcatttgcaccgtcgccgatagcaatagaatgttgggaataaataccgtattcctctaacaaatgttgcaatgttttagctttatattgggcatcaaccacatcgcctttaactaagcctgtgagttttccatcttcaatatcaaattgatttgatgcagcaaaatcaagttgcaataaggctttcaaataatccgcaaaataagtaaatccgcctgaagcaattgcagttttccagccatatttttgtaaggtttggatcgtttcaactaatccagacattagcggtaaattctctctaacttgctgcaaaatgctttctggcgcaccttttaatgtacccactcgacaacgcaaactttgctcgaaatctaattcccccctcattgcactttccgtaatcgcagaaacaagttcgccaacacccgctagtttcgcaatttcatcaatacactcaatttgaatagcggtagaatccatatccatcaccaacaaccctgcttgagacaatttagggctgaaatctaatttagcaatatccacttcaacatcgtgagcaaatttaatgaaatcagaaaaccattgacctttcaataagacgataatatttttcgctaccatccaaacatcaaaaatctgaaaattttgaccgcacttttgttgaaatttttctagcttagttatgtccaactttgtgccgtataagataaaaggctctccgttctgtataggctcctcattagccaaaagtgcggtaggaaattgtggatatttttgtgtaatactttcgaaacattgaatttgcataaaaatcctgtaagttgtggcgactaaaaagattttaaccgatgtgaattgaaaaagtgaaaataattaaagaaaaactactcaatgatacttgcaacgattatttcgctaagcctagcgatatttggcgttatcttatttggtgtaaaacaagtattttttaagtcattatcgctgttcttatcataaactcaaagagaaaaaagtgcggtaaatttgacaataaaatctagtagtatgcgttttcatcaatgtcgtcgtagaatttgattattgtcacaaactattaaattgagtgcggatttttgctaaatttccttcagaaataaggtagaatgcgcaagattatttttcaaaacgaattatcacaggagaacaaaatggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgtgaccgttttgtgctttcaaatggacacggttctatgttgatttatagtcttttacatttaactggctatgatctttctatcgaagatttaaaacaattccgtcaattacattctaaaaccccaggtcacccagaatatggttatgcacctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggctgtttaatggaagggatttctcacgaggcttgctctttagcaggaacattaggtctgggtaaactaatcgcattctacgatgacaacaatatttccattgatggtcatgttgatggctggttcagtgatgacaccgccgagcgttttgaagcttatggctggcaagtaatccgtaatgtaaatggtcacaatgcagagcaaattcgcgctgctgccgttcttgctcaagcagaaaaagaaaaaccaacgttaattatttgtaaaaccatcattggttttggttctccaaataaatcaggttctcatgattgccacggtgcgccattaggcgatgaagaaatcgctttaacccgcaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattggcagcagaatttaaacgtcgtgtttctggcgaattaccaacaaactgggcggcagaatctaaagcgttcatcgaaaaatttcaagcaattccagcgagtattgcaagccgtaaagcatcacaaaatgccattgaagcctatgcacacctattgccagaatttttaggtggttctgcagacttagcaagctccaacttaaccttatggagtggttcaaaaccgattcgtgcccacgaaaacgtaagtggtaactacattaactacggtgttcgtgaatttggtatgtctgccattatgaacggcattgccttacacggcggtttcattccttacggcgcaaccttcttaatgttctacgagtatgctcacaacgcagtacgtatggcagcattaatgaaacaacgcacattattcgtttatacccacgattccatcggtttaggcgaagatggacctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtattaaaagactgtgatggcacacctgagttaattttcattgcgacaggttctgaagtggaattagcagtgcaagcagccgaagcattaagtgctgaaggtaaaaaagtacgcgttgtttctatgccaagtactaaccgtttcgataaacaagacgaagcataccgtgaaagtgtattacctgcagcggtaaccaaacgtgttgcgattgaagcgggtattgctgacttctggtataaatacgttggattcaatggtcgtgttgtcggtatgaatagctttggcgaatccgcaccagcagatcaattatttaaactctttggtttcactgttgaaaacgtggtagcaaaagcgaaagaaattctttaagattaaactaaactagctccttgatattcaaggagcttttttattggctattgaaaattattgtgagatatgaaataaagaaaggaatagatttatacttaatttctcagctttctaacgcaaactacaactttttattttctgcagtttctggctctaaatctaattttgccatcaataactgatcgccatcttcttctggattatctgtaacaagtaatttatcgccatagaaaatcgaatttgcccccgccataaaacacatcgcttgcatttcttcagtcataccactacgacctgcagaaaggcgaacataactttttggcatagtaatacgtgcaacagcaatcgttcgcacaaactccgtccaatctaattcttccgcatcggctaacggtgtaccttcaaccttaacgagttgattaatcggcactgactcaggttgcggatcaagatttgcaaggctcgcgattaatccagcccgttctttacgggtttcattcatccccacaatgccaccacaacacacttttaatccagctttgcgcacttttcctaaggtactaagacgatcatcaaaacggcgagtaccaatcacttctgcataatgttctggtgcggtatcaagattatgattgtaataatctaatccagcttcttttaaatcttccgccataccgtcttgcaataaaccaaaggtaccgcaagtttctaaaccaagtgatttcacggctttaataatttctgtgactttctcaatatcttttggcttagggcctcgccaagcagcccccatacagaaacgtcccgcaccacgtgctttcgcaatttttgctttagcgacgatctcatcaacatctaataactgctgattttgtacgccagtatgataacgggctgattgagggcaataactacaatcttctgggcatccccccgttttgatagacattaacgtggataactgaatcgcgcgaggattaaaatgcttacgatgaacttgcgttgctcggtaaactaattccaaaaatggcgtttcaaataacgcctcaactttgcaaacagaccaatattctacacttggatgaggtgtaatagagttaatttgtaatttttccgctaacatgtttttcctttgaaagtgcggttaaaaacaccacgctttttatactttcttaattgatgaattagtgtatatggtagaaacaatcaattcaacgttatgaatgaaactaattttacacccctttttgcaattgacttatctgaccattttccaccactaacacttgatctatcgaaccgattaattccgatggttggtgggtaacaagtagcaatgttaaatctttctcgtcacaaagtttagcgattaaagccagcatttctacccgaagtttctgatctaatgcagaaaaaggctcatctaataacaaaattggcttatctcgcaacaaacaacgcgccaatgccactcgttgtttttgcccccccgaaagagaattcggtaaacgctctaaataatcgcccaatcctacggagcaagcggcctgttcaattttttcctgctcaagtgcggttaattttaaagagggttttattcctaaggcaagattttgttgtacagtcaaatggggaaataagttattttcttgaaatagcatggaaacaggacgctcgtaaggcgcactacgcgtatgatttttatcgtttaaccaaatttctccttgagcaggaaattcaaacccagcaattaaattcaataaggtacttttccccgccccactttcgccaataattgcgacacgttcgccagccttaacgttcaaattaaagcacattggtaaggttttatcattcaaaatcacattatttagataaatcatcagcatccctatatgtgtgaataaaggcaaacaatatgccacaaagcaataataaaatccctgcggttacagcggcatcttgattacgataattacctaactgctgatataacaaatgcggtaaagaagtaaactcttgattgccaaataacgcaatagccgtaaaatcgccgagagataacgccaaacctaaagcaaaagcataacgcaacggtgcgcgcaaggttttnccactcaatcagataaaaacgtgccgggtaccgagtcgatatcgtaagc

SEQ ID NO: 491 - DNA, 4017 bp, H. influenzae
  misc_feature (2502)..(2502): n = a, c, g, or t
gagaccccattttatcccgccagtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaatagcatgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcatttttttatgataagtcttgcggatcgacgtccaaaattaaccgcactaggctgtttttttcaagttcggcttgttgatattctcttaatgctttttgcaacgtcattcttgacggatgttgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgaataacgcctgaaaagtaaaaggcggcaatcccattgaatggcgtaattgtaaggtttcttttgcaaaagcttggtagccatttgccaataaagtggtaagcaaaggatgatcaggataatgtgtttgtagcacaacttcaccttgtttatcggcacgtcctgcacgtccagcaacttgaatataaagttgagctaaacgttcttctgcacgaaaatccagtgaaaataatgcactatctacattcactaaggcaacgagagtaacattcggaaaatgatgtcctttcgcgagcatttgtgtgccaatcaaaatttggcttttgccttgttgaatatcttctaaataaccttccaattttcctttacgtgccgtgctatcgcggtcgattcgcgctacagaataatgaggaaatagcggtctcaaggtttcttctaaatgttctgtgcctagaccagtagtaactaaatgggtagagccgcaaatcgccacattggcgaggaatagttctttgtgcgccacaataatgacaacgccaatacattntgatgctgatgataggtataaggtttttcacaatgagggcattgtgcgatccaaccacattcatggcaaagcaatacgggtgcaaagcctcgtcgatttaagaaaagcaacacttgattgcctttttcgagatgggctttcattcgttccaacaagggttttgataacccgttttgtatattttgatttttcaaatcaataacgaaatgacgaagtgcggtagaatttcccgctctttttgataaaactaaatgttggtatttgccgttttgtacattattaatactttctaaacttggcgtggcggagcccattaataccgcaatatttagtttttgagccagcacaatcgccaagtctcgcgcatggtaacgccaactgtcttgttgtttgtaagacgaatcgtgttcctcgtccaaaataattgcaccaagattagaaaattgcgtgaacaatgccgatctcgtgccaatcacaatggcactttgtccagagcgggcgcgatcccatacataaagccgttgcgtatcggttaaattagaatgcagtacatcaatttctacattaaaacgtgctttaaaacgttgcaccgtttgaggtgttagcccgatttcgggtacaagcactaatacttgcttacccgattttaaaatttcttcaatatactgcagataaatttctgttttacctgaaccagtcacgccatcgagcagccatacattgaaaccagaatggaagagcagttggctgaaggctaaggcttgctgcttatttaaggttaaacgattttcagcattgactattgggttattgcctaatctttgttgccagcttaggggatttgtttggatagtaatttcttcaataaaccctttggcttttaaggcagaccaaatggcagaggaaaaattattattgcctttttcaagatcagtttcagataagcattgtagggcttcagcttgctttttcgagcgttttaattcgccttgttcaagggcatttttccccgcatccgtaattcgccaaaaagtgcggtcattttttaccgcactttcgccgttacgcaatttcacaggcaaggcttgaaataacacatcgcctaatcccgcttgataataatttgctgcccagtgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttgggaaaaaatttgccctattatacgagaaaaattggtataatcgccgccaattttttcacgaacaagatttttatgacacaaactttgccgatcaaaaacgggtaccgagtctgatattcgtataacag

SEQ ID NO: 492 - DNA, 5436 bp, H. influenzae
  misc_feature (101)..(101): n = a, c, g, or t
  misc_feature (5156)..(5156): n = a, c, g, or t
  misc_feature (5265)..(5265): n = a, c, g, or t
  misc_feature (5294)..(5294): n = a, c, g, or t
  misc_feature (5391)..(5392): n = a, c, g, or t
taataatacgggtaattcatcagcaggaatatcagtaaattctggaatatattgatgccctccccatacgtaattttggagtgagcctgtaagttataaantcattatttatttctattttaactagcgtaaccgtgggtaagtatacccacggctagttatagtcgttcctctttgaggaatctcacactaccccaacggggtagccttaaaattagcctaggatatacctaccctaggcaatttgtcttcccctagattatttatttaaccgcaggtaagtatacccacggttagttatagtagctcctctttgaggaatctcacactaccccaacggggtagtattgagattaacctagggtatacctaccctaggcaatttgtcttcccctagattatttatttaaccgcaggtaactataataaataaaaaatccgcacaaaggcggacttttttttatcgtaaacaaattatttctttaaggctaatactactgattctccagccactacttcgcctgatttttttacgatacaagaaatttcatccatatttgaaattacgattggtgttaagacagattttgcttttgattctaataaaggaagatcaaattcaatcacggtatcaccacgcttaatagattgaccttcttgtgcaatacgagtaaagccttcgcctttcaactcaacagtatcaataccaaagtgtacaaataattctacgccttcttttgattccattggaaaaagcgtgattggtttcaaaaattttaccaatcacaccatccactggcgcaacgattttgttaccaataggacgaacagcaataccatcgccaacgattttttcagagaaaaccacatcaggaacatcttcaatattaacgatctcgccagagatcggtgcataaatttcaacttccacagatttgttttcttttgaaccaaataacttgtcaaataagcccattttaatctcctatccattcaagatggatgctattttaacgtaaaatcaaatacttttgtttaatttaatgaattttccagcaaaaattcttcaattaattgatcaatttctgcagcggtcggtttttgtaatgcggcatcagcaagcgcttttgcatcttggaaatttacattacggattaattttttaatgcgaggtacagaaatcgcactcatgctaaattcatctaatcccataccaagtaacaataaagtcgcgcgttcatcccctgctaattccccacacattcccgtccattttccttctgtgtgagaggcatcaatcacttgtttaattaaaccaagcacagaagggtgcattggattataaagatgggaaataaactcattaccgcgatctacagccaaagtatattgagttaaatcattagttccgatactaaagaaatctacttcttttgctaaaaattttgcatttaccgccgcagagggagtttcaaccatgacacccacttgtatgttattatcaaaaactctcccttcttcacgtaattccgcctttaatgtttcaataaccgcttttaattctcgaatttcttctaccgaaataatcatcgggaacatcactgccaatttaccaaaagctgaagcacgcaataccgcacgtaattgtgcatttaaaatttcacgacgatctaacgcaatgcgaattgcacgccatcccaagaatggattcatttcttttggtaaatctaaatatgaaagctctttatcgccgccaatatccatcgtacgaagcacagttaagcgtccgttcattgcttctaccacttgtttataggcaataaattgttcttcttctgtgggaagctgttcacgatccataaataaaaattcagttcggtatagcccaatcccttccgctccattacgttctgcgccgtcacaatcacgaatcgtcccgatattcgcgacgatatcaaccttatgtccatccaatgtaatagctggaagatcttttaatttagctaactctgctttttcctcagaaattttcgcttcaagtgcttttaattcatcaatttgagatgccgttggattaatataaacttgattatttatcgcatctaaaattaagtaatcgcccgtattgactaatttagtcactttatttgtgccgacaatcgctggcaattctaaagaacgtgccataatcgaagtatgggaagttctgccaccaatatcagtgacaacccctaatactttttcgagattaagttgggcggtttctgagggagtcagatcataagcaacaagaatagattcttcctgaatatcgccaagatcaacaatgtgcatgcccaaaatatttttaactaaacggttagcaatatcccgaatatcgcctgcacgttctttcaaatattcatcatcaatttcagataacattgtcacttgttgatctaaaattttactcgctgcaacccctgcattcactttatttgaacgaagataatcaagaatttcttcttctaattcttcatcctcaagaatcatcaagtgaccttcaaagattgcggctttttcctcgcctaaagaaattaatgcacgttctctaattgaattaagttgttctaccgccgcagcacgcccttcataaaatcgagcaacttcttcatcaatttgatcatctgtaattttttgcgtatcaagaacaatcttttcttctttaagaacaagtgccttaccaaaggcaatacctggggatgcgagaatgccagaaatcatagataccttccgaaacaattaacaaagtaataaataaacaatagccataaaatttcacaattttatggctaagtaagaattattctaaagtaggaattaacgcaactaaatgttcaactgcctgttgctcgtcttctccatcagcagaaatggtaagtattgttccctgcgttaaaactaatgtttgcaacttaaataagctctttgcacttgcacttttcccccctgaggttactgtaatttcagaagaaaatgctttcgcttctttcacaaattgtgcagcagggcgcgtgtgtaaaccgtttggtgcaataatttccacatcttttgaatacataatgctacctcgactaatcaataattaaaaatataaaaccagaaaattgccctagtatcctttttcaaaacaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagctatcataacgaacaggcgaaattttgccttgctcaacggcttcacgcaacgcacatccggggtcgctcaaatgtttacaatcacggaatttacaggtgcccaaaacatattgaaattctcgatagccttttgtgatttgctctgcatctaaatgccaaaggccaaattctctaattccgggcgaatcaattaaattaccgccttgtggcaaatggtaaagacgtgacgatgtcgtggtatgctgccctaagcctgatgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcttgtgccaataaatccactttattcaaaacaatgagaggcgtgattcccgcaatttcacacacaacaagataacgatcgataatatttaaggaaagcgttggcaacaccgctgatacaataataatacgatcaatattcgccgcaataggtttcaaaccatcataataatcagggcgggaaatttcattttctcggggatggatcgcctcaatcacgccactcacaccttgtaattgttcattgcctttacgccaaacaactttatctcccaccaccaaactcgacaaggtacgacgcaaattacaacgataaatttcgccttgttcattttcgacatctgcgtgaatagaataacgtgtgaccacaacgccttcttgtgattcgccaagcatttcatctgaccattcaatgtcttttttcttatggcgatgtaatgttttcgcattattcgattgaattcttctagtttggttttgagttaatttacgtttagccataaaagtgcggtcgttttttcccttgtttttggtaaaatgaaaaaaatttttgcataggatacctgatattatgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataattcgggctcattcactgatgtgaactgcgggaatagctcagttggtagagcacaaccttgccaaggttggggtcgcgagttcgagcctcgtttcccgctccaatttcacattataaaagcattattgcgggaatagctcagttggtagagcacgaccttgccaaggtcggngtcgcgagttcgagcctcgtttcccgctccaaatttcaatccttagccaaaagctgggggattttttctatctacaaaaatagatcatcaaaatgttaaaaagtgcggntgaattttctcaaaaaataaaggcttgtngatttaataacacaagcccttatttttatgctttcttcaaccgtttggcacgacgtttcattcttcttaccccaacgggtattcgccatgcatgcgnntattgatagacataagggaaaataaatgaaaagccaacaacatc

SEQ ID NO: 493 - DNA, 4282 bp, H. influenzae
gccaaacaaggcgccatagcgcatctccggcatgcgtgagcacaaagaatctgatttagatttagctcgaatttaaggccgccacttgtggatgcagattatcaaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaatttttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcactttttatatgaaaaggtatgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatttaaaaagtataatgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcctaacgacataaattgtcgcttcatcttttatcattaagccatcaacagagagggcattaaaatgaagaaaattgtttatattgatatggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactcatagaaaaatgaccgcactttttaaacaaatagcgacttcggtcgctatttatcattttttctcttgcttaagcatatgcataataagcctaataagcgtttctttttgtttcggatcagattcagcaactaataaagtgagcgcggcaagcccagtatcattgataactgggtatccattatgatcaaacaaacgcccatttctatgtaagaatctacaaataaaaatgcgccgctacgtttattacctctgaaaaa

SEQ ID NO: 494 - DNA, 7106 bp, H. influenzae
  misc_feature (7056)..(7056): n = a, c, g, or t
  misc_feature (7071)..(7071): n = a, c, g, or t
atggtatacgaatatcagactcggtaccctttcttggtgccttcgccttttggtaattctgcatcaaaaatgaatttatcgccacgtttaagaaaatttaccgtctttaaaagtagaaacacgaattttaggaccttgtaaatcacctaagattgccacggttttacctaattttttcgcaatagaacgtacacgttcagcacgtccgatatggtcatcaggtgtaccgtgagagaagttcatacgaactacgtttgcgcccgctgcgataattttttcaagattgttatcacggtcagttgatgggcccatagtacatacaatcttcgttcttcttagtcttctagacattatttactccgtcaataattacaaaattttaaaggtgttattttacttcgctacatatattagccagataaaaaatcggtgcacattatacgcttaaaacttttggaaatcaaaaacggctcagttatttaagctggttttgtttacttttttgccagttatatcgggttttaagaaaaatacttgtgttcaagttaaaaatatctataatcacgactacttcacacagtgcgactatagctcagttggttagagcaccaccttgacatggtgggggtcactggttcgagtccagctagtcgcaccaaattttcttttcaatccctctcaatccatatcaaataaaattaaatttcctggtaaatcaaggcattatctgcttttataaagtcaatctatatcaatctatattaatctaactcacttttttggtattatatttggtaatataattttggatttttaggtgtcgtaataccaaaattcataaaaatactaaaaaatcacgcttaccaaaattattttcgtaataccaaatggggggaaggatggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgttaagatgaatagcagcctgattcaattctttcaatgtaatcatttatttgtgcatcagtccaaaagttattcccaccgactagatgaggctttggaaaattggggtcgttttttatccttctgtaaattgttggtgcgctcatatctaataaagcagaaacagttttcaaattatgtaattttcttgtcgtagattccatatttcctccaataaaaaccgcccttatgggcggttataacggtttattttagttagcccacttcatctaacttattcatctttttgtaaagaggatagggcgatttaatgggttgtaaatgggttttaaaaatcgttcgggtcgtcgtcttcctctagctctatcacatcaagccgttgaataacttcaaatttagctaaaaaacgcagtctgttctcaaaatcaccatctctccatacatacataacttcgcgttccggttcttcaaacatatcccaggaataagcgttttctttcgcgatatgtaaagcgacattatcaaaacacctactttcatcttcccatgtatttccatcatcattgtttgtaggattgttactttccaatgcgtaacgatataaatatttagccataatttattcctccggtggttgtggtagcggttgccaataaataacctccacttcctcgccagggttttcatccgattcccaatacggaattaaacaaccttcacaatccgacttatcgtcatataaataccagccaagaccaacagcccaatgatcaccatcctcagtaaaataaattaggtgtttgttagttgcattacgatactctaagtcggtagaaaatggttctggtagttcgtttgcacaattaatccagccattattttcactcatttttcccctccaaaattgctttgcgttttgctttaataattggcgtaactacccgtttaatcgccagttgcaattcacctataaaggtctcatctttcatattgtcaaatgcaatacccatcaacttcgtcaaacacaccaccttcccagtctaatagcacgatatttccgcctaacacttgcgtattttttgatattttaagttgatcacgttggtagtcgtccatttcaacttcgattgttatgcggactttttgggttatttcattgctcatttcctactccttttcctttgtaacttggatattcagatctcaaaatccgataacaatttgtttttaactcaaaaatgcttctcggcagagcgttaataggcaatgttttacaggctctcccggtgtcgtccataccatacggcacaccgattgcgcgccaacatcgtgcggcatgtaccgctgcgtctttaaccacatccgagttaatcacaaagctattcggcccaatgcgttgcaacaaaacaccttgtgccataagctttttaacccgccgtctaaattgactttcgcttaatccagagccttcaataaggtgtcttacactcaatattgcaaagtcttctgctcttttctctgcatgatcatcgctatacgtgccaacactgccaccgatatacgttaccaaggtgtgttgtgcgatgcggtctaatgtttcatcccagatatactcaaggatatgttcgtctagcactttcatatcttccccaatctcattctcatccctgacaaccgctccgaacatttaatccattcgctcatatcacaccaccaatacatataatagccattctgtgaatcctttcatgcttactcctaatataaatcttctgagaacagaatatctgagtttggtgaaccagataaacgaattacttggttctgagctttagcaatttccattgcttctttacgacctacaaaacgacctttattagttagaaacccttgttcccaatctaaaagagcatacttgtattgtttttctaattctttaatctgcttacgcatgaatgggtcatagtgtcttaaaccatatacttcatggataatctcaccgccatcttcatttgtaccatctctttcatctacaaacacttggcaagcagagcatacaattctttcaggaatatctacatattctcttttttggtttaagagtttaataaattcattgaataatgtttgtctttcttcaggcgtttgttgtttgattaaattaataatatccatcacttactccatcatactcttcataaaatcaagccatttttgagcatcttcttttgtgcggaaacattgaccatttatcatcaagttagctgcacaatctgcataaaacgaaaaatatctaatcactccatcgcttaaatagaaaaactcatcgccaatatgtggtttaaacggcttaggtaaagtgcttgtgtcgaattttggatcaagtttttttacaaagaaccattccatggtcagattagcgagccatggttggatgatgccatcttccggctgcatcacaaactcgccgtttttagttttggcgataacttttagaggtaaatcaggattaccatcgcatagcactagcaaatcctcattacaagccttttccagcacttgttctgacgttagtttaggatcttcccacattccaatgatgtcatattccatggttgcccaatgtactgatttacctgttaagttccatgatgtcgtattaatgtaaataccatcaaatctatacccgattaacggatatacggtatctcttacctctagcttttcaacctcgttaagcaaattgtatttaacaacggcttttcctccatttctcaacatcacaggctcgccattcaaggctgcttttaagttaaattctttcattttctttctcctaaaacaaaaggcgctcacttggaacgcctattggatttatttgtttaaataattaatcattctttccccgatccacttaataaccggtacagccatactattgccgatagctttatagcgtgggctatccgggcaatcttcggctggtttatttcgatacgatatttgcgtataacctggaggaaaaccttgtaatttttcgcattctgaaggggtaagtttgcgaatgttttggttgatgctcatgcatggaatgttattcccacctgtccccattcttgcggtaagtgttggcgtagtgccgtccttttgtatgcgcacaacatcgcgtcgatctgaaatatcgaacaaaacattttcctgcccattattgcgccccaggcagtgggcagttgatgtggaaataatcgggtcttgcgtaccatgtactacaatagtttcagagccaccaccaagcgccccaccactagcttttactagcccccccaatacggattggcgatacgttccaaagcttccctcagcgtagcaggtaaaaccttgttgcgtttttccgcacgattgagaatacccttgcaagcttttgcgctcaaaaagtatttgggcgacgcttctttctctagcacttgccacaaggaacacgcgcttgcgtcgttgggcgagtccgaagtattgagcatcgaggattcgccacgcgatagttcgggacgaatgcacataaccagcgtttgaccatttagcccctgttggttgcagtggctcacgctcttgaaccaatccagccaaaaggtgtccgaatgcgttgtcttttgtggatagtacacccggaacgttttcccacaacaaaacgcacggctgcttaccgtcttggtatctaacataatcaatagcctctaatatgtgtattaaagttaacgtgagatttccgcgctcgtcatctaacgagtttcgcaaaccagcgacagaaaatgcttgacaaggagtaccaccaacaagcacatcaggcgcaggaatttcacggtttaagattttttcgggtaaggtggtcatatcaccaagatttgggatgttgggataatgataagcaagcacggcgcaaggaaaaggctcaatttcgctaaaccacagcggtttacttaagcctttccatgccacgcttaccgcttcaatccctgaacagattgaaccgtaggtaaacatagtgcggttattttttcctctgttttggattaatcacaggcaacacaggcacaatcggttttgctgttgtagctgttgttgatgggctactgcggttttcatttatccagtcaaatagttcctcccacgaatcgtagtcaagtttgtggaatgcgttatttcggtcgcttgcccagcgtttcagatgctcattaatatcgcgagtaattacctctcgagtattactgcttatcacgctccatttggttttaacattgtgaattgtttttgttttgttgtattgttgtggtggctctgttgtatccgccttgaccaaccctaccattttcgaccttttgcacggttacttccattatcatttctcttgttttgcgccgcatactgttttcacacccacttacagtgccatattgttccctccgctcttccctcgtctgacagctctcttcggttctcttccatccctcttgactctcgctttctcaggcccatctatttttccatgttttgcacccccatcttctcaatcactttattctcaattgttgatgaaccgctactcgtatcgagcacttatatcgtctttcgcctcatgctttcttctctccctcgaacttcctcccagacggcgactgtttctttcgccttttagcgtttttgtactgttctgatagagtgccaggtcgttttcgtgactttttccgctcctggttatccgctcctttcccccgctttgtgctcctcgtgtactgtcgtgtgcgccatgcctgactcttggcgccctctcctttagcttcctgtcttccgtatccttatacgtcctaacgtcctgattgcccgttcttcctacatacgtttcactttatttctctctccnccctccgatcttctntgctattgacgtcctggtcgctcgcgcgcgccccg

SEQ ID NO: 495 - DNA, 5007 bp, H. influenzae
  misc_feature (4834)..(4834): n = a, c, g, or t
tggtatcgaaattcggactcggtacccctcgtagtgctttcgccactatttgaatcgcttctccactactaattccttttgccataagttcttgaatttgctcaactgctttttgttgctgttcgtgtgttaagttaatatcaaacattttcccacccaaattgatttattaattgatgccattgttcatctaaacctgctgtaattgttatttgctctttcgttattggatgaataaaagacaaactattagaatgtaaaaataatcgagaacaacctaaatgtgacattaatgcacgattttgatgtaagtcaccatattgcgtatcccctaaaatcggatgaaaaatatgtttcatatggcgacgtaattggtgttttctacctgtatgagggattaatttaactaaagaataacgtgccgtttgataacgcccagcaggataaggcatttcgactatttttaatccttcataatcagtcactgcttcttgaggctctttatcttcttgagaaaatttatctgcgattttatccaattgaatttttagtggataatctatccgctcttttccctgtagataccctcgcactacagccaaataagatttctgaacgcacttttgttcaaactgttcacacattaaattcgcaatttcactgctcaatgcaaataacaacacgccagatgtcggtcgatctaaacgatgaataggaaatacgtgctgaccaatctgatctcgtaaagtttgcatcacaaattgagtttcgtgaggatctaaccaactgcgatgaaccaacataccatcaggcttattcaccgcaacgagaaactcatcttgatataaaatttctagcattggttattgttcagaagttcttctaaagcaactaaaggagttaatagttgttgtaactcatcaaattccttcattgcttcttcaatataaggagaaatagcaattttatgtggcaaggctgaaccactttctaataatgcctgcatgcgtggaataaatacccactgtagccactcttcggcagacatcgtatcaattgaaaaaggttcttcacttaaaaacgcctctgcagcagggggcatcgtttgccataaattaagctgctgcatggtaatttgaagctgttcaagatgctgtttagtttgattacgcatattttatatcctaattaatgaatgttttttgcaaatacacgcacatttgaaaaaccattttctttcaaatataaggcttgtaatttactcatcacaccacgttcacaatacaacacgtaatttttactttgatcaaggctaccaaattgagaagaaagtttgtagaacggcatttgaatgacgtcatgtgtacctgattcaaatggcttttcatccgtttcttctgggctacgaatatccaaaatcacttcattttcacctaatacagaaattgcctcgacttccacgacttctttttctgtttcttctgcaatctggcgaatatctaaatatttcgcattttgcaccgaactttcaagaatctcgaaattaaaatgcccttcttcttctagaatcttttcacgaaccgctttgatcgtaggattttttgaaatcacgccacaaaattcaggcatagattttgcaatatcgtcagtaccaatttctttcgccatcgcgataatttgttctttatcgtgcgtaattaacgggcgtaatactaaggcatcagcggcttcatcaatcaagcgtaaattggttaaagtttggctagaaacttgtcctaatgcctcccctgtcacaatcgcttcaatattgaaacgttgagcgactttacttgcggctcgcaccatcatccgttttaatacaacgcccatttgtccgttatcgactttctctaaaatctcaccgacaactccctcaaagttaatcgtaataaagcgtactttatgtgaagcactatagcgttgccaaatatgataagccatttgtttaacgccaatttcatgggctgcaccgccaagattaaagaaacaataatgaactcgggaaccacgacgaatcaacatataactcgatacgcctgaatcaaatcctcctgaaattaaagaaagcacatcttcttgcgtaccaatcggataaccgccaataccagcgtgacgtgttttaactaacatcattttgtcatcttcaatatcaatacgaacagtcacatctggattttttaaccgcacttttgcgctttcaatatgttgatttaatccaccgccgatataacgttctgcttcaatcgaactaaatttatgtttacccttacgttttactcgaacgcaaaaggttttgccttgaagttgttgcgcgacatccgcaagcgtcaattcaaaaatatgatgtaaatcggtaaacggtttttcttcaacttctaaaaaatgatgaataccaggaatacgttgtaacaaggcgattaattcttcacgattctcttcattttttgaccgcacttcaatgtaatcccagtgacgtacaactgcagtttcttcatcatatttctgtaaaatattgcggatattagaggttaaaatttttgcgaaacgtttacgcacagtttcgcttttaatcatgatttcaggaaaaagtttaacgataaatttcatataaatagcttaggtatttcttgggtatttaaagtggcgagtattttacgcaaagatagtgaaaagtccactggtcctagcttgaaataattttttaacaactcaaataaaatacagtacaatggcaaacaatttttaccgtgaaaaaggataattccatggcgcgtaaacccgcatcttcacaagattttgaaacaacgttagcgcagttagaaaatattgttacacatttagaaaatggcgatctaccgttagaagaagcgttaaaagaatttgaacaaggtgtgcaactcgctaagttagggcaagaacgtttacaacaagcagaacaacgtattcagatcttattgcaaaaaacagaagacgcgccactgaatgattataaagggaatgattatgaagggaatgcttaatgggtcacttttctgaagaattacaacaggttcaaactcgtatcaatcgctttttagaagctcaatttgagggcattgaaagtcataatgcacttttgcttgaggcgatgaaatacgcattattacttggcggtaagcgagttcgccctttcttagtttacgcaacaggtcaaatgcttggtgcagagaaacaaaccttagattacgctgctgctgccattgaagccattcacgcctattccttaattcacgatgatttacctgcaatggatgatgacaatctacgtcgtggacatcctacttgtcatatccaatttgatgaagctacagctattcttgcgggcgatgcgctgcaaagtttcgcatttgaaatattaaccaaaacaccgaatatttctgctgaacaaaaactggctttaattcaaattttagcgcaaggcgctggcgtacaaggaatgtgcttagggcaaagtttagatcttatttctgagcataaacagattagtttaagcgaattagaattaatccatcgtaacaaaacgggtgcattgctaattgccgcattaaaattaggtttcatttgttctccacattttaccgacaaaaggttagaacaatccttaacacaatatgcggaagccattggtttagcctttcaagttcaagatgatattttagatattgaaggcgatagtgcagaaattggcaaacaggtgggtgccgatcttgatttagataaaagtacatatccaaaattacttggattaagtggcgcaaaacaaaaagcgcaagatctatatcaaagtgctttgtctgaattagaaaaaattccttttgatacaaccgcacttcgtgcattagctgaattcgttattaccagaaaaagttaaacactcacaaaagtgcggtcaaaatttatcacgtttttaaaatgactaataatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgttgagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtcatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttccgccaatcaaaaactttatgaaaaaaaccgaagaacatatgaaaggtgtaatgttttcgccagaaagtacattatttgaagaactcggttttaactatattggcccagtggatgggcataacattgatgaattagtggcaatgcttacgaatatgcgtaatctgaaaggccacaatttttgcatantaaaacgaaaaaaggtaaaggatacgcacccgcagaaaaagatcccgattggtttccacggtgtacctaaatttgatccaatcagtggcgaattgcccaaaacatagtaaaccactattcgaaaattttggcgattggctattgaaaggcagaaaagatgcaaattattgttt

SEQ ID NO: 496 - DNA, 4891 bp, H. influenzae
cggagagagaagaagagcggacgagaggaagcgaagggagggatataaaggggataatcaaagaaagacaaaaggaaaggaggaaagacgttaaaaaggggtaaaagaaggatggaaatgacagatttctggaagataaagagagttcataagaagaaaggcaaaagaaaatcaaccgcaaagagaaaagaagtaagtctaaaaaaaggattaaaaacaaacaaaagagtagtattgaatagaatgaggggaccaaaaagcaggattttatgtggacgagggtcaaaaatataagtaattaaaggaatcccgggaaggaggtttaagttgttccctgaaagagttaaaaccagggttacatttattagtgtttgggattgggcataaagagaaaataaaatttactccgcatattattcactacattggtagcaacaaaccttggttaaaggaacattcagctaactctcctcgtttttataatgaagaatacttgttttatcatcatctttcttgggataatcttagacagacagacagacagacagacagacagacagacagacagacagacagacagacagaaaaatataacccaattgccttgtatgtcaaagtgcggttaattttgaccgcattttttcttttggaaggaaaattacattgagtttattttatatttaatccatatcttacctagcattttgtgatctacatcataaaaccaacataaaattatcgcttgaacaaaacaaaatcgctactatataccctaaattttgttattccaccttttcaaaactaacggagtattttatggcatttcgtattgaaaaagacacaatgggtgaagttcaagttccagcagataaatactgggctgcacaaactgaacgttcacgcaataactttaaaattggcccagccgcatcaatgccacatgaaattatcgaagcttttggctatttgaaaaaagcagccgcatttgctaatcatgatttaggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgcgcacatgtgataaacggtggaaaattaggtgaaaaatctattattcacccaaatgacgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaatacgctgccacatttaagccaattagcattgggtggaactgcggttggcacaggtttgaatacgccgaaaggctatgatgttaaagtggcagattacattgcaaaattcaccacacttccgtttgtcactgcagataataaatttgaagcattagccgctcatgatgcgattgttgaaactcacggtgcattacgtcaattagcaatgagtttatttaaaattgcgaacgatattcgtctattagcatcaggccctcgttcgggaattggcgaaattttaattcctgaaaatgaaccaggttcttcaattatgccaggtaaagtaaacccaactcaatgcgaagcgatgacaatggtctgtgcacaagtatttggtaatgacactacaatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgctggtgaccgcacttaatacgaatatcggttatgaaaatgcagctaaaattgcaaaaaccgcacacaaaaatggcaccacattacgtgaagaagcgattaatttaggtttagtgtctgccgaagattttgataaatgggttcgcccagaagatatggtgggtagcttaaaataattcatcgcacaaattaacattacaacgatcaaaggcgagtaaaattactcgcctttttactgatttctaatttgctttttgatgcggtttgttataatcaacaaaattttattcacggctatttattatgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaatttgcgattacgctcattaaagaaatcgaaaccttaaaacttaatgatggcgatactcaaagctggcttaaagaaatgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaaggataaattcagttttttatattttgtgccataaaaaatacctgtttcccaataaattattatcaaggaaaccggtatttattatttgaacattctctatctgactaaaatttttcccaaactgggataacgctatcaactaaatctaaattttttcctaactcaatccagccacaagggaaatgaaaatcggagccaacggatcccagcagattaaattcttttgcccaacgagcaagcatttgacgctgatcttttgtttgaccacaatccgccatttccattccatcaccgccccaagccttaaaatcgactatcagcttacgcacccatttccccgtcatgttataacgtaatggatgtgcaataatagctataccgcctgcggcatggattgtctcaatcgccgtgggaatatcagcccattcagctttaacaaatgctgattttccttgccctaaatagcgtttaaaggcctgaccatcattagataccttaccaatctgcaccaaataacgtgcataatgagcacgcgtcacttcgccatcggctaaggcttttgccccgtcataagcatgaggaatccctgctttttctaatttatcgccaatttccaccgctcttttttcccgtaatgctttttgactttgcaaaagtgcggtcatttttggatgagttttatcgaagtttaatcctacaatatggatccctcgcccttcccaatttgtcgaaatttctactccagtaatcaattcaatgcctacttctttcgctgtaatctcagcttcatcaatacccacaatcgtatcgtgatcgcataatgccagcacgttcacaccttgcgcataagcacgatgcactaattcagttggactcaacactccatctgatgcggtactatgacaatgtaaatcgtatttttttgtcattatttaatattttttactaattcttttactaattttggaccgtgataaatcaatcctgaataaacttgcaacaactctgcaccagcctcaattttctcttgtgcattttgcaacccatcaatgccgccgctaccaataatcggaatctgacctttcagttcttgatgtaatcgcttaataatctccgtgcttttatgctgcaacggctttccacttaatccgccttgctgttcggcatttttcatccccataaccgtatcacgagaaaccgtggtattcgttgcaataacgccatccattttatgacgaaccaatgtatccgcaatttgcactaattcactttccgttaaatctggtgcaatttttaccgcaatcggcacatatttattgtattggtttgccaaaatagcctgacgatccttaatgcttcgcaataaatcatcgaaataatcaccatattgtaattgacgcaaatctggtgtattgggagatgaaatattcaccgtaatataacctgcgtagttataggctttgttcaaacagaaaatataatcatctttgccttgttccaaagatgtaaatttattcttaccaatattgatgcctatcacacctttataacgggcgtttttcacattttctataagatagtcaataccattattattaaaaccattacggttaataatgccttcagcttcaatcaaacgaaactgacgtggctttgcattcccatcttgtgcaacgggcgtgactgttcctacctcgagaaaaccgaaacccaatgtaccaaagccgtcaatcgcatcgccatttttgtctgcccctgccgccaatccaatgggattaggaaaatttacacccattaccgttttcggaaagcctttgggagcatgaataagagattttaagatcggttgaaataaaggattactggctaatttcaagcattgaatcgtgaaatcatgagcctttcagcatccatttggaaaatgccgtgacggaataattgatacatactg

SEQ ID NO: 497 - DNA, 5002 bp, H. influenzae
  misc_feature (4906)..(4906): n = a, c, g, or t
  misc_feature (4914)..(4915): n = a, c, g, or t
tataagcccaaccaggcgccaacgcagtaacagtttccttgagagaaaacataacaaaagatggggtatttctggaagagaaaccaatgccaccaaaccagaaatgagggcttttaggtaagtaaaatagtgttaataaatggaaataatagttgccatctaaagttttcgatttaataacgagattctccatactcaagtgcggtagaatttgccaagttttacttagccagtctacgttttctaaacgaaatacccaatttatccgcatattgcttcattgtattcgttccagagctaccgcctgcataccaacgcttttcttgaaaaggaaccaacgagacttcaactaaggcagtttgataacttaaccccccacctatacgcaaagtagcctcattgtattttttattatcccaataatattttccattcccattaaacatagttttactaaaaaaatgatctgcccatggccatttttttctactgataaagaataccctaccccccttcccactttctttttcccaagcggtccaactaccaatttttgtgccactttttggagcgttattcaaattatcatcatttaaaaaatttaagcctacttgccatatccattgattccgctgatttagtgttaaaagatactgatcaataacacctaaaaatttttcatcatctacctctgtacgtaatttttcaaattgaattttggcagattcattttcatagttaaaaaatagggcttgagctaattgataacgcaaaggtagtaaagatgcgtctagagcgaataattcacgataataagcaatagattgagttaaatcaccttgttcacgcgcgtcaatagcctttgcccaagtgagtaagaaattatcgtgctgaggaaattgtttatatagtggtaataacagttgaactgcctgagtgttattttgatataaagcaagaattaacccacgcaaaacaagtcttggatgttgtgctaattggcttttggaaagagaaataatatgcctatttggtatttctttcttaggcatagaggaaaaagaggaggtttttaattccgcactttgaatcgtatttgtcagtgtatcatttttaggacgtgcaacttttgcccaagctatattcgttaatgataagcctattaatgataagcctattaatgataagaaagaaatttgttttacgccatttttcatattttatccatattcttaaaaaactctaacttgacattattacaaaaaaagaacaataatgcgaattattatcaattttgtataagtattaattctatgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaagtagaaacaaccaacaagtagaaaaaaacaaataatggaatactaaaaatgactaaaaaaccctattttcgcctaagtattatttcttgtcttttaatttcatgctatgtaaaagcagaaactcaaagtataaaagatacaaaagaagctatatcatctgaagtggacactcaaagtacagaagattcagaattagaaactatctcagtcactgcagaaaaagtaagagatcgtaaagataatgaagtaactggacttggcaaaattatcaaaactagtgaaagtatcagccgagaacaagtattaaatattcgtgatctaacacgctatgatccagggatttcagttgtagaacaaggtcgcggtgcaagttctggatattctattcgtggtatggacagaaatagagttgctttattagtagatggtttacctcaaacgcaatcttatgtagtgcaaagccctttagttgctcgttcaggatattctggcactggtgcaattaatgaaattgaatatgaaaatgtaaaggccgtcgaaataagcaagggggggagttcttctgagtatggtaatggagcactagctggttctgtaacatttcaaagcaaatccgcagccgatatcttagaaggagacaaatcatggggaattcaaactaaaaatgcttattcaagcaaaaataaaggctttacccattctttagctgtagcaggaaaacaaggtggatttgaaggacttgctatttacactcaacgaaattcaattgaaacccaagtccataaagatgcattaaaaggcgtgcaaagttataatcgattaatcgccaaagaagatggatctaatgcatactttgtgatggaagatgagtgtccaaaggattataacagttgtataccttcagccaaaccacctgcgaagttatcctcccaaagagaaaccgtaagcgtttcagattatacgggggctaaccgtatcaaacctaatccaatgaaatatgaaagccagtcttggtttttaagaggaggctatcatttttctgaacaacattatattggtggtatttttgaattcacacaacaaaaatttgatatccgtgatatgacatttcccgcttatttaagatcaacagaaaaaccggatttagaaaatagttctttttatccaaagcaagattatggtgcatatcaacgtattgaggatggccgaggcgttaaatatgcaagtgggctttatttcgatgaacaccatagaaaacagcgtgtaggtattgaatatatttacgaaaataagaacaaagcgggaatcattgacaaagcagtgttaagtgctaatcaacaaaacattatacttgacagttatatgcaacatacacattgcagtctttatcctaatccaagtaagaattgccgcccaacacttgataaaccttattcatactatcattctgatagaaatgtttataaagaaaaacataatatgttgcaattgaatttagagaaaaaaattcaacaaaattggcttactcatcaaattgtcttcaatctttgggttttgatgactttacttcagcgcttcagcataaagattatttacctcgacggtgttaccgctacggcaaagagtatttcagagaaacctggtgaaacaccaagaagaaatggtttcaaattacaaccttacttatacccaaaaccaaatgcnatctttgnnaggacgagatcattgtaattatcaaggtagctcctctattatagtgactgtaaaggggcggtaatttaagggaaaaattattattca

SEQ ID NO: 498 - DNA, 6987 bp, H. influenzae
acctgatgaccgaaaccgccttctccacgttcggtttgttgaaaatcttctacaatattaaattcagcttgtactactggcacgaaaacaagttgagcaatacgatcgccgacttcaattttgaatggttcatttccacggttccacattgataccattaatggcccttgataatcggagtcaattaatcccacaaggtttcctaacacaatgccgtgtttatggccaagacccgagcgaggcaaaatcacggcagctaaattgggatccgcaatataaattgatagccctgtcggaattaatttggtttcgcctggttgaatttcaaagctttcatcgatcaacgcacgtaaatcaagacctgctgaaccttcagttgcgtaagttggcagaggaaattcatttccaatgcgagaatctaaaatttttacgtcaatttttttcatttaatactccgtttgaaattcatttttaggtaaaagtgcggttggaattataaggttttttgatagcgttcgatgatttcattgactaaatcagcggcaagttctacttttgattttagcgataattttttatgaccatttttccaaaaaagctgcaaggcattttcatccgcgttaaaaacttgtccgccagatacatcgttggcacaaatcatatcaagatttttgcgttcaagtttatcttttgcataatcatcaatattttgggtttcggctgcaaatccaacagtaaaaggacgatgtgtttttaaatgtcctacatctgagataatatcgggatttttaattaacttgatagatatttcatcgccagattttttgattttttgttctgcaacttcagctactctgtaatcagcaacagccgcacaaccaataaaaatttgattttttaccgcactttcaagagaggcttgccacatttcttgtgctgagatgacattaattcgatttacattttttggtgttgttaaattcactgggcctgaaatcagtgtgacgtttgccccacgtttggcaaatgcttcagcaatcgcaaatcccattttccctgaactatggttagaaatataacgaacgggatcgattgcctcacgcgttgggcctgctgtaatggcgacatttaatccttgtagatcttgtttttgagagaaaaagtcagaaagtgcggtaaaaatttcctctggttctgacatacgccctttccccatatcgccgcaagcttgaaaaccactattggggccgataagctcaatcccacgtgtttgaagagtcgttaaattttgttgagtaatggattggtgatacatctgctgattcattgctggcacaagaaaaattggcgcatcagttgcaagacaaattgttgaaagtaaatcattcgccatgcctacagtaagacgggcaataaagtctgcactagctggcgcaataataatggcatcagcccatttggcaagttcaatatgccccattgccagctctgcttgtggatcaagtaaagattgcgatacagcattgccagaaatggcttgaagtgtcaaaggagtaacaaattctgctgcagctggggttaatactacacgtacttcagcttctgctttgcgtaataaacgaatcaactctattgttttataggctgcaatgccgcccgtaataccgacgacaacacgttttccgtttaaattcattttcttcccttgttagtacttaaccacaatttcgttattttactttaattttattgaatgcccaacgctatttttacgatatgcatcgcagattttgaatcacttgctcgtcaaacctaaaaagtgcggtcaaaatctttcttatttttcttttataaatatatggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttattataaatttttataatattgaccatttttttaccgattacattcaggaaaatcgcatttacacttgagaaatgaaaacaaagtcagtataatttgcgacctttaatatagtaagcgggtcggattagcgcgacctgacgaggtagcaagctaggtttaaccagctttaaacaatccgaaccgtaagctcgagcttatatttaattattggagattattatgtctagagtttgtcaagtaacaggcaagcgtccagctgtgggtaataaccgctcacacgcaatgaatgcgacacgtcgtcgttttcttccaaaccttcacactcaccgtttctgggttgaaagtgaaaaccgtttcgtaaccttacgtttaactgcgaaaggtatgcgtattattgataaaaaaggcattgatgcagtattagctgaaatccgtgctcgtggcgaaaaaatctaaggagctaaaaaatggcagctaaaggtgctcgtgagaaaatccgtttagtttctactgcagagacaggtcacttctacacaactgataaaaacaaacgtaatatgcctgaaaaaatggaaatcaaaaaatttgatccagtagtgcgtaaacacgttatctataaagaagcaaaaatcaaataatattgatttaattattttaaacccgagtagaaactcgggttttttatttgttcttattagaaacgtttgctttttatttagccgtttgactcgtaagaagctaaatttgcttttcatattgcaaaaagaatatacaattgtccccgttttgacgtaaccctacatcaaaacctgtttccaacctagcccgtccaatgggcaaactagggtaaaaacaaaaaagctgaaacgctttttttaataagtagcgagtcaaatgccctatgtgtctgttttataaacagtaaatttatcgcaaggcacccgacttatttttttcacctcttttagaaggttttaatcaaaaatgacaatgattacccctgtacaagcaattcttgcttcaaaccaacattttttagatcgccaagatgtaatggaatccaacgtacgtagttatcctcgcaaattaccttttgcctatgcaaaagcacaaggctgttgggttactgatgttgaaggtaatgaatacctagactttttagcaggcgcaggaacccttgcattaggacataatcatcctatattaatgcaagccattaaagacgtattagatagcggattgccgttacacactttagatttaaccactccacttaaagatgcgtttagtgaagaattattgtcattcttcccgaaagataaatatatcttacaattcacaggcccttctggtgcagatgcaaatgaagcagccatcaaattagccaaaacttacacagggcgtggcaatatcattgctttctctggcggttttcacggtatgacccaaggggcattagccttaacgggtaatcttggtgcaaaaaatgccgttgaaaatttaatgcctggcgtacaatttatgccatatccacacgaataccgctgcccatttggcattggtggcgaagcaggcgcgaaagcagttgaacattactttgagaacttcatcgaagatgtagaaagtggcgtagtaaaaccagctgcagtaattttagaagcaatccaaggagaaggcggcgttgttccagcaccaataagcttcttacaaaaagtacgtgaagtaacccaaaaacacggcattttaatgatcgtcgatgaagtgcaagcgggtttctgccgttctggaagaatgttcgcctttgaacacgcaggcattgagcctgatattattgtgatgtcaaaagcagttggtggcagcttaccattagctgtattagctattcgtaaagaatttgatgcttggcaacctgcaggacatacaggtacatttcgtggcaatcaattagcgatggcgacaggttacgcttcacttaaaattatgcgtgatgaaaacctcgcacaaaatgcccaagagcgtggtgaatacttaaccaacgcattacgtgaattaagcaaagaatatccgtgcatcggcaacgtacgtggtcgtggcttaatgatggggatcgatattgtagacgaacgccaagcgaaagatgcgataggggcttacccgcgcgattgtgaattagcggcagcaatccaaaaagcttgcttcaaaaacaaactcttgctcgaacgtggcggacgcggtggcaacgtggttcgcgtgctttgtgcggtaaacatcaaccaaagtgaatgtgaagagttcatcaaacgcttcaaacaatctgttgtagacgcattgaaagtggtgcgtagttaattaaaagcggtctgattttgcaaatgttttgcgaattttgaccgcttgtaaattcaaaatggtagggaaatcccaccttttttctactcaactgtataaaactgggatatacttatgctatatacaattaagcataaggaataactatgattgaagcctctgtttttatgactaatcgaagtcaagctgtgcgtttgcccgctgaagttcgcttttctgaagaaatcaaaaaattatcggttcgtgtatcgggcagtgatcggattttatcgcctctcaaccaatcttgggatagttttttcttgaatgatcaagcagttagcgatgattttatgaatgaacgagaaattgcatttcaaccagagcgtgaggctttatagtgttgaaatatatgcttgatactaacattgtgatttacgtgattaagcgtaggccattggaaattctttctcgctttaatcaaaatgcaggaaaaatgtgcgtgagtagcattactgtggctgaactctattatggagctgaaaaaagcgaatatcccgaaagaaacattgcggttattgaagatttcttatcacgcctcaccattttagattaccaaccaaagcatgcagctcatttcggcaatattaaagctgaactctctaaacaagggaaattgattggcgaaaatgatattcatatagctgctcatgctcgtagtgaagggttaattctggttagtaacaatttaagagaatttgagcgagttatagcattacgtacagaaaattgggtgtaattcatatctaggaataattatgtcaaacctcaaacaacacaaacaagctttgttttgcaacgataacgaagccattaacgattatgaaacagcgatgtataatgcggtgcaagcagtctctgcttggctgaaaaatgaaaaaatgtacacaggcggttcaatcaaacaaatgcgagccttaataagcggttttaatccgacgaaagagggtatgggtgtacagaaatcactcgatcatttggtaaaaattttccttaatccaagccttaaagtacatcatccacactcacttgcccatttacattgcccaacgatggtaacaagccaaattgcggaagtactgattaatgcgaccaaccaatcaatggattcatgggatcaaagcccagcaggttcaattatggaggagcatttgatcaactggctacgccaaaaagcaggctatggcgaaggcacatcaggcgtgttcacttctggtggtactcaatctaacttaatgggcgtattgttggcacgcgattgggcgattgcaaaccactggaaaaacgaagacggctctgaatggtcagtacaacgtgatggtattccagcagaagcaatgcaaaaagtgaaagtgatttgttcagaaaacgcacatttctctgtacaaaaaaatatggcaatgatgggcatggggttccaatcggtcgtgaccgtgccatcaaatgccaatgcacaaatggatcttattgcacttaaacaaacacttgcacagcttaaagctgatggcaaaattactgcctgtattgtcgctaccgcaggcacaacagatgctggcgcaattgatgatttaaaagcaatccgcaaacttgccgatgaatatcaagcgtggttacacgttgatgccgcttggggtggcgcattattgctttccaaagattatcgctatttcttagatggtattgaattaactgattccatcacgcttgatttccacaaacacttcttccaaacgatctcgtgtggggcgttcttgttgaaagatcctgagaactatcgctttatcaattacaaagcggattatctcaattcggaatatgatgaagctcacggcgtgccaaacttagtggcaaaatcgctacaaacaactcgtcgtttcgacgcattaaaattatggtttacccttgaagcattgggcgaagatctttacgcttcaatgatcgatcacggcgtaaaactgaccaaagaagtcgagcaatacatcaacgatactcctgccttagaaatgcttgtgccaagtcagtttgcatcggtgttattccgtgtcgtaccaaaaggggtaccgagtcgatattcgaaaaca

SEQ ID NO: 499 - DNA, 5826 bp, H. influenzae
  misc_feature (5802)..(5802): n = a, c, g, or t
cctttattttgagtattattatcattagtattgactaataatatttgctattcttttatctgatatttgatattttgtccccaactgctgggcaaataaactcacacgcaattcctcgatcatatagcgaatttccgcaatttcatcagaaatcggtttagattttggcagtttagccagtaattgttggtaagcctgttgcacttgttccacgcgtagcatcgcagcacgatcacggtttacatcttgagccaacttatcaatacgtttatcaatggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaaggttttctcgaacgaaatcacgcaatttttcaaatcctgcttcatcccacacaaaaccgccaaaattggcaattagcttatctacggcacaagcaatacagtcatcgatcaaatccaatacgcgaccgaacggagtaaaatacagacccaatttagccttattcggcaatttttcatgaagatatttaattggtgatggcacattgagcaataacaaacgacgtaaaccttgttgcatcgccaccgattgctcaaactctgtttcaaacagtttgatacccaccgcatctttttcatctacaatagctgggaacgctttgacgctgaaaccacgttgtttttgttcataacattgtggtaaatctgcaaagctccaaatatgcagcctgctttgctcaatgccatcatctgccacagcagaaatactttcctgcacacgatcttttaagttgaatttcagctcatccaaattcatggattctgcgattttcttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcaggagtataattaggtgcaggcacgaagttacggcgataagatttcggcagcgatttaatcagcgcaatcaccaactcttcacgcaagcctggaatttgccagtcaaagcctgtcatttccacttggttgagcaatggcaatggaatatgtactgtcacgccgaccggcatcggtacctggttcaaattgataagtcaatttgagttttaaattgccttgataccagaaattcgggaaatccagtttgctcacttgttccgcatcatcattgatcaaaaatgaacgttcaaaattaagcaattcaggatctttttgctgcacctttttccaccacgtatcaaaatgcttctgggaaaccacttccgtgccaatacgctgatcgtaaaattcaaacaatgtgcgatcatccaccaaaatatcgcggcggcggcttttgtgttccaattcttctacttcttgaacgagcctttgattttctttgaagaatttatgcttggtattccaacccccttccaccaaggcagattgaataaaaatctcacggcttaccgttggatcaatagcaccgtaattcactggtctcgcagccacaatcggcacaccgtaaagtgtgactttttcatctgcaatcacggcgccacgggatttcgaccaacgcggttctgaataggattttttaatgagatgctcggcaagtggctcaatccattctggctcgatttctgccaccatacgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccgcttaaaagtgcggtatgaatttgctgatattctgctttttcagaattaatcggtaagcccatttcacgcacggttaaacgaatttgatgataaatatcctgccattcacgaatgcgtaaataatttaagaaatccttttggcactgacgacggaattggtttttactcaattctttttgttgttcttgtagataataccaaagattgaggaaagccaagaaatctgattttttatcggcaaaacgacgatgtttttcatcagaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgcgcccaattcttccaacagttttatcccatcttgaatatggcgtttatctggcgcatcaacaaatgggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgctgtacctgggtcaatcacatatttaatgccaggtacggtcaatgaggtttctgcgacgttggtcgccaatacaatgcgatttaaaccgcttggatggaaaattttattttgttcttgcgcagacaagcgtgcaaagagcggtagaatttccgtgtattttagattttgtttttgtaaagcttcggcggtatcacgaatttcacgctctccattcataaagatcaagatatcgcctcgaccttctgcttgcaattcatccaccgcattgagaatgccttgtagctgatcttgatcgtcctccactacgggacgataacgcacttcaacaggataggttctgcctgagacttcaatgatcggtgcattattaaagtgtttggaaaagcgttccacatcaatggttgcagaagtgataataagttttaaatcacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacggactttataccccactaaatcgccaagttctgtttccagttcttccgcaatacgtgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaagcagtttttgaatttcgactttgcgttggctaacgggcaaactctctggaaaaaaatcggattttgtaccgcacttttccgttgttctacacgtaatctagcttgttcaatttgctgttggatttcagcggcaacggcttgttgagcctcttggcttttaatttttccaataccatgaatgcgggcggataagcgacgttgatccacccgcatgatgtcatttaattgagaaaaaagagattgttgtaagggagttaatgtgtgttttaccgagctgtttttcatagcgatttacttttgaaacttccgtaagctaagctaatccatccgattaaaaataaagtgccgccaataggcgtaatccatacaattacattgcttgcttcgaaagcaagtgcgtataaacttccactaaataataagattccaattaaccaagaagacatagataatcgggcgaatttattgtcacgtaaagcagataatgcaacggcaagtactgcaatggtatggaacatttgatattctaaccccgtatcaatccatgataatgctttggcttctaatatatggcttaggccatgagctgcaaatgcgcctagtgcgacacagaagaatccgcttaaagtggcaatagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttacctgcaagccatgccacaagcactccaactgcaatagaaagagccattttccaactaagaaaacctgataaatcaggcaactgaatttttcctgaaactaaggggcttaaaaccccaatggttaaaataatgataccaattttaacgccatatttttcgagcaaaggaatatgagaagataaaaaagtttgctgcatgataagtaatacggcagcagaaatggtaattgcgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagtcggtaaaattcttaaatcatttattcttcaaatttaccttttttttctttattgatggtgcattttgcactagcccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattcgctttagaaaatgcagcatttaataatgcagcaactacagctaaagcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgtaattaaagtcacaatagaaccaatttgacttactgaacgagcacgatcacgtaagacttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccactggggtactcttcagaagngactcgcaggcagacaagtctggc

SEQ ID NO: 500 - DNA, 4160 bp, H. influenzae
tcagcaaatattgaaattgggctttgacgtgatcgtggaacacgatgcaggttttaaagctagttttgaagatcaagcatttttagaggcaggcgcgaagatcggtacgtcggctgaaatttggcaatcggatattatcttcaaagtaaatgcaccgacagatgaagaaatcgctcaaatgaaggaaggagcaactctcgtgagctttatttggcgcatgcaaaatcctgagttaatgaaaaaactcaccgcgaaaaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcaaagtatgggtgcgagcttcttagaaattgatttcaaagaagaaggtggcagtggcgatggttatgcgaaagtgatgtcggaagaatttaaccgtcgtgcgatggagctttatgcagaacaagctaaagaagtcgatattattattactacggcagccattccaggtaaaccagcgcctcgtttaatcaccaaagaaatggtagattcaatgaaaccaggttcggtgattgtggatttagccgctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatatcaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgccagctgcatttttatcacatttcaccgtatttgttttagcttgtgtggtgggttattacgtggtttggaatgttagccatgcacttcacacaccattaatggcagtaacaaatgcaatttcaggcattattattgtaggtgcgttattacaaattcgtcagccaacaggcaatctatttatcgatgcgttagcttttgtggcgattttggtggcaagcatcaatatttttggtggtttccgtgtcacacaacgtatgttagcaatgtttagaaaaggttaaggagcgcacaatgtctgaaggtttagtacaggctgcgtatattttagcagcattacttttcattatgagcttggcaggactttctaaacatgaaactgctaaagcaggttgttggttcggtattgttggtatgacaattgcccttatcgcaaccatttttggccctcattctgaaggaacattttggatcattattgcgatgatcattggtggagcaatcggtgttcaacgtgcattaaaagtagaaatgactgaaatgccagaactggtggcgattcttcacagttttgtcggtttagcagctgtactcgttggctttaatagctatggtttacaccatgaggcgttaatgccagaaggattagatgcagcagcacaagccgcatttgtagcagagcaagtagtattaacgaatattcataatgttgaagtatttttaggtatttttatcggtgcagtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtggtatcaatgcttaactcttattcaggttgggcagcagctgcggcaggttttatgttgaataatgatttgctgatcgttacaggtgcgcttgttggttcttctggtgcaattctttcttacattatgtgtaaagcgatgaaccgttcatttgtgagcgtcattgcgggtggttttggtaacgatgttcaagtttcttcaagcgaagaacaaggcgaacaccgtgaaactacagcagaagaagtagctgagttgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgattttgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaatccattattcttcaaagagaatacgcaaatgctctttggtgatgcaaaagatcgcgttgaagatatcttaaaagcattataaaaaacacgtataaaaataaccgcacttggggttgcttaagtgcggtatttttatttatagcatttaaatattatcttcatgattttccaaaatttctgaacacaagcctaagccagataaaaattcaataaatgcccgtacttttattggtaaatgtcttctgtttggatagaccacatgaatttctaatttttgttgtttatattctggtaatatttcaataagctcgcctttttcaaaggctctacctaaaataaattttggtaaattagcaatacctagtcccgcttttgccatatttaataaggcaaaaccgctattgcttaccactttggattggattttgaaacgttgggtttgatttatacgtgaaccaacccaatttacctgattcattgcatttttataaagtaagccattgtgatgttctaaatcatcaggcgtttgtggaataccattcgtttcaagataattaggcgacgctgcaaaatgaacagtagtagttcctattttacgtgaaactaacgagctatcttccatataaccaatacgaagagcaagatcatagccttcggataataaatcgattttcttatcattaaattcaacttcaatatgcaaatgaggatgcttagccataaaagtgggtaaatttggtgcaataaaaagtaaaccaaaatcacgaggaacggaaatcagtaaatttccttgtaatgaactggtaaggtgggtgatgctggaatctgcttcatctaaatcaagtaaaattccttggcagcgttgataatacattattccagcttcagtaggcataatttttctggtggtacgttgtaacaatcgtgtttttaaatgttcttctaattgtgaaactaatttgcttgccatcgccacagaaatattttgttgctttgctgccaatgtaaaactttgagtttcaatgactttgcagaaaatagaaatcgcgttgagtttatccatttatagaccttttttgaaaaaatgcttgattttgccaacataactttgcactataccgccaattttacaaaattctagtgatattaggtaatcaaatgagtaaatccttggtgattgtggagtcgccagcaaaagcaaaaactattaataagtatttaggtagccaatatgtcgtgaaatcgagcgttggacatattcgtgatttgccgacggttggttctagtacaggtgaaaaagctaaaccaatttcaaccaaaggtatggatgccgaag

SEQ ID NO: 501 - DNA, 5873 bp, H. influenzae
  misc_feature (1441)..(1441): n = a, c, g, or t
gagacccctttgtcaaaaggaacgatcattaactccatgaccctaaaagacgtgccaacccagatattatcaaaggatctcgccgtcgtcgtattgcattaggttctggcactcaagtgcaagatgtcaataaattacttaaacaattcgatgaaatgcaacgtatgatgaagaaaatgcgtaaaggcggcatggctaaaatgatgcgtggaatgcaaggcttaatgggcggaggcttaggcggtttaggcggaatgtttaaacgataatttcagaagataaaagtgcggttaaaaaagaaatatttttaccgcacttttgtgttttatgaattatagctaatttataaattattctaattaacgacgttgctgttatggaaactatatttaattttctcttttaagtatgtgaaaaaattaattaatgtttacgatgatattaatttagatagaaaaggagagccgaacgttaatttttcaggcaatcttttctatccagccaaagcccgttgcaaactttgcgtccaagcggttctaaatgcggcatctttggcaaaaagtttgtatagctctaattcatccctatggcgttcgctcatcacatcgcgcaaaatggcttggaaagccaattcacgggtatgaatatccgggttattttgatatttctgctcaaagtctttatggctgcggatgcgctcggtaatattgataaattttacccgttgctcatccggcgttgcgctccaatcttgaaaccatctttcgttaaatacacgaataatttcatcaatcggatctttttctttatcttcaccatgcgtaccgcgcggattggggttttgcgggtcaagctctgtttcttcatcatctaatttaatgctgtaattcagcttggtgcgcgccaagccgtaagagcttaaatccactgcatctaaaatttcatcaaattcatccatcgggtcttgtacttttaatttgggtactaagaatttgaggaaccaatagagcttttcccaagcgatattttcaaaattgatgatggaggccatttgcccgtaaatttttaaaaactgttttgccttgattttaaaatcaactttttcatttcgatccaaatccaattccaattcatcatcaaaacgttggacagccacatcaatcatactgcttaattgctgtgcgtctttattggcaaaatagccttcagtaaaatcgttgacctccgcttgttcgtacacgccggtttcatccaaccggtctttcaaatcatgcaagacattgacatcggttgcctgcgacaacgaagtagaagtataaaacggctcaatgcctgctgaatatcttcaacgctgttaaaaaagtccaatacaaacaaatcttccgtgcgtttactcaacttattcgcactgcgattcaaacgagataaagcctgcacgcanagcacgccggagagtttcttatccacatacatggcacacaatttcggctgatcgaaaccggtcagatatttattggcgaccaccagcaaacgatattcatcttgatcgaaaactctttggtttcgctttctgcaaagccgttcatttccgcttcggtgtattcgacaccgtcaaccactttactgcctgaaaacgcaatcgcaattttaaacggattaccccgcccggccagcaaatgttttaacgcctgaaaatagcggatggcggtttcaatattttgcgttaccaccattcccttggctttgcctttgagttttttacggttgaaaacttggtaaataaaatgatccagcattatctccgctttagtatcaatcgtttgttgcgaacgctccacataggctttcagacggctttgagcctttttactatcaaactccggattatcttcaatcgacttagtgatctcataaaaacttttataggtggtgtaattggcgattacatccaaaataaagccttcttcaatcgcctgcttcatagaataaaggtggaacggcttaaacttgccatccgcctgtttttcgccgaatttttccaaagtgctgtttttcggtgtggcggtgaaagcaaaatacgacgcattgccgtgcattttgcgggattgcatggtttgtaaaatcaaatcttgcacatcttcagcatcaaggtcttccgttttgccgatggcccggttcatattgtcgtgtgccgaacctgattgtgagctgtgtgcctcatcaataatcaccgcaaattgtttgtcgcctaaatcagcaatgccatcgacaataaacgggaatttttgaatcgtggtaataatgatttttttgccctgctcaagcgattggcgcaactctgccgaactcaacgccggcgcaacaatgtttttaacttctgaaaaatctttgatattgtcgcgcagttgcttatccaacaaacgacggtcggttacgacaatcaccgaatcaaaaatcgggcggtctgcctctctaccgtttgccgccttttcattgcgcggatatgcctcaatcaactgatacgccagccaagtaatggaattagacttgcccgaaccggcagaatgttgaatcaaataacgtttacccacgccatgttcactgacatcagcaatcaaacggcggaccacatctaattggtgatagcgagggaaaaagagggtacgtttatccaacggatctttggttgaaccgtctaagcgcataaaatgctgaataatgttggcaaggcttgctttgccgaacacctcttgccataaatacgccgtgcggtgtccattgggattgggcggattacccttaccgcagttgttgcccaagttaaacggcaagaaaaacgtagcaggccccgccaatttggtggtcatataagcttcttccgtatctaaggcaaaatgcgccaaacaacgcccgaaatggaacaacgtttggcttaaatcacggttgaggtattgtttttgcgcatcaatggctgtctgacctgtccaatggtttttcagctcaagggcaataatcggcaagccattggcaaacagcaccatatccaccgtttcattgcttgaggcagaataaggcacttgacgcatacagctaaacaaattctgttcaaaacgctgcttgaccttttcgccgctgctggcaagcggaacggggtagagcaaatcaaaatgggcgctatcaatatccaagccttttttcagcaggtgcaacacgccgtttttctttatttggcggtctaatcgctccaaaattttacgctgccagtcgtttgggttgagttgttgaaaacgggcaagttctgcctcttggctggtttgcaggaattgccaaaacagacgtgtgtcgatggcaaactgcgcatcaaaatcctgtgaaaatgccagtttaaaaccatgatggcgcggcaggtattcagccttcggctcgcccagcttattttccatgttttcacgccaagtgcccagttaaggctttttcgatggcaatttctaaatctttttccttagttcctgaaaccatttttcacccttttgtgaattttttaaatttattcattacgcccaagttgtcgcgccgatattcaaaatccatcggattttttgaccgcacttttcacacctatacccgcaccttgccggtcaccacatcgttaatcaacacgcttttatattctttcagcttttcaatatgggctgtttttaatgcgattgctcgatcaattttagaggtttgtttatctaggtagtcggcaattttttgctgttctaaatatggaggaataggtagtaataattctgcaaaatcagaatagcgaaaatctgttgaacgctctctaattcctttagctaaggagctaataaatcctgataatgcaagatttcttaagtaataagcgtaaaaatagacatcgattttttgtttatcatgaggcaaacaaacggaataaactggtgttgctttaccatctgaatcagaaataccaattgcccctgcaaaagcatccatagcgtgaataactaaatcaccttttctaattccttggtagccgtgttcttttagcgcatttgtaaatccttcagttcttcgattagctctcagagttacttgcccatccctaaaacaagtaacaatttggtcttcctcattcacttttctttctattttcttgaaaatgaattttgaacgttgcacatcccaatgctccggcacttgccctatccattccacgccggaatcttttaacggcacatcagggtttaagcctcgggttacggcattttgaatcaggatctgcttgtgctctttcaacagggcaatctgcttttccgccaaatccaccgcctgatcgattttagcggttttatcgtctaggaattgcgcgattttttgttgttcggagagaggtggaataaccaaaatactgtctgaaatatgcccatagttaatcgtttgtcttacacctgaacctaataatttcatatatgcaacatcgtatctatgtaataaatacgaaaagtattttttattaattatttgtttttcttttaaaacaatgtaaccggcacttacaacaacgtctatttctgataaagcaattctcaaactaattaggtcataatttaagtttaaaggatttattaaaaactcgccttttaacacctcttgatatgaacgttttgttgcctctgttactttatcatccgatttttcaataactttaccaaaactaatggctccacaattaagagacaggctttgcttatgttttttttcaacaaataattgtttcaagcgttttaactcccaatggctcggtacctcccctagccaatccacacctgaatctttgtaacgctcgtatcgtctcatttgcaaaaaatccttaaaatatgaccgctcttattgatgcaatttgttgtccgtttaactataaaaaaacttgcttatttcatgccaaatcttgcttaaaagataaaaatcattatttttcagcaagttaagcattgtcaatttccttgcttagcaagcgataaaccttgcttaatcttttctaaaagcatatttggcattggggtcacgctgttttacactttgtctttcaataataccttgctgaataaaggcatttaaatacgctcggatcgaattctgattgatttttgtatagtcaactaattctgacaatatcgccgtaccatttgtaaatagataaagcaaaatggctttttgggtgtcgttgtagtttgtccattctttttcaatctgcagcatagtggctgtagataccgttttttcatgtgcggtaacacggttgcgcaatgttagataaacattgttgttttgttctctatattcaggctttgccaataatgatttttccattgactcataaatacgggaaacgccttcattaagctgacggacatacccaagatcctctaaaactcgtgctatacgtggattccgagcgaatcgttccgttttaatattttcaatggtgacttgagcagggagagggccactattactaatttcaagacgatcgtcgaaatgtttaatataaataacattaccttgaacattgtaagaacgatgacaaagcgcatttacaacaccttctaaccaagcttcttcaggatattccggtactttgataaattttccctgattgacatcaagaaagtaataatcccttaaagaggctcttaaaaaataggtcagctcctcaattagctttggaatattattttcaaaacgttggtcttttatcacattatgctcagtaccgactttcgctactgtaccttcataacgaacatagcggactgatgctgaaggaatgtaacggggaaccgagtccgaattcgaaaaca

SEQ ID NO: 502 - DNA, 5556 bp, H. influenzae
  misc_feature (3223)..(3223): n = a, c, g, or t
tttctggtaacacggtaagcgttaaagcaaccaatgatttaattaccaaagcaaattcaaaaattgaagcaaaaacaggcgaggctaatgtaacaagtgcaacaggtataattggcggcacaatctctggcaatacagtaaatgttacagcaaatactggtagtttaactattaaaggcggtgcaaaagttgatgcgacaaatggagctgcaaccttaactgcagaatcaggcaaattaaccactcaagcaggctctactattacctcaaacaatggccagacaactcttacagccaaggatggcagtatcgcaggaagtattgatgccgctaatgtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtagtcagtaattgacgaggtagatttcatcctgcaatgaagtcattttattttcgtattatttactgtgtgggttaaagttcagtacgggctttcacccaccttgtaaaaaattacgaaaaatacaataaagtatttttaacaggttattattatgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtctactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagtttataactatatgctttacccgccaatttacagtctatacgcaaccctgttttcacccctgtatatcaaataaataaaccaagcaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaaccaagtaaagtaaactaagcaatgctaaaaaacaatttatatgataaactaaaatatactccacaccatggcgatacaagggatttaataatatgacaaaagaaaatttgcaaaacgctccacaaaatacgaccgtttcacttgtggaatcaaacaacaaccaaacttccccgcaaatgcttcaacaatcacccaaacctagcctattgcgcttggaacaacatatcgaanaaaaagattatgagtttgcttgtcgtgaattaatggtgattctggaaaaaatggatgctaattttggaggcgttcacgatattgaatttgacgcacccgctcagctagcatatctacccgaaaactactcatttattttgccactcgtctcgctaatgcaattacaacactcttttccgaccccgaattggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaataacggttttttaaagtaaaagtgcggttaattttcaacgagttttaaaatctctcaaaaatcaaccgcacttttatatttataacgctcccgcgcgctcacagtttatctctttcttaaaatacccataaaattgtggcaatagttgggtaatcaaatttaattgctgatacggtaaactaaagacggcgcgttcttcggcagtcatgtcttgtttttccaattcttttaaatgtgtttcgatactttcttgctgttggttaaaaatagcttcgggtatttcttcaatgtgttctaaggtataaataattttctttgcccaggataaaaccagataaaacctgtgcgggctgttgaaatttttcattctgcttcgatagcctcccgtgctgaatatagctattagagacaattcggttgagtgagcacacctttttggatgttgccgtgagtttcctggtccttattataggggaatggcgctgcgtcgggggcttttttgcatcggctttctgtcccttct

SEQ ID NO: 503 - DNA, 7347 bp, H. influenzae
  misc_feature (6850)..(6850): n = a, c, g, or t
  misc_feature (7186)..(7186): n = a, c, g, or t
aacattatgatgctaatcaagtaattttaggtaaaactatggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagctaaaaatgaagcaaagtgcggttgtatttcaccgcacttttttattttaggagacattatgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatattaaataaaatcccctatgccgataagctataggggatttactacattaataatttattttctattcaaccacgccatatattcagtcacgccttccgcgactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgcagccacatcgcctacataaacaaaatcacggcggaatccttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtgtctccataagttgctgcgcttgaggcatagaaaaaaggaatttcacggtcaaggcaataatgcaacaactctttagaatattcgtagttgttgtgcataatgtatttaccatcccattccgtagtcgcagaacatgccccctcgtggaataccgcatcaatatcgccaaattcatcgcccgcaataatagaagcaatgaaatcttctttatcgcaataatctgcgatgtctaaatcaactaaatttgcaaatttcgtgccatcttttaagttatccaccactaaaatatctttgcgccctaaatcattcaatgctttgacaatattactgccaataaaaccagcgccgcctgttacaataatcataattctgtcctctttaaaataagtttgcgtattgtaatagattttctaccgcttagccaaaaaactctgcgaaaaacaaccgcacttttaatccccaataactcgtaaggcctgtcgtaacaagatccattttgcctttactcaacaacacaattgtgggtgtcacattaatttgccatcgttctgcaaattcccctttaggatcattaaccgtagtgaagtggtagtcatgcttacttaaataatcatttacgtccgcctcattgcctgagcgtaatgccaccgatacaacttgatagccttcgtttgctaaagaattaattgctggcgaagtataacgacaataaccacaccaagttccccaaaaataaagtaatgtgggtttgttttgatcaagactatcaagagagaacgtactcccttgaagatcttgtaacgtgattttatttatttcctttggcactacagggcgacgaacaaaatccagtatgctagttatcacaataaaagttaaaaagagggataatccattcttgagtaattttttaatcttcattttatttattccttatcttgttgagatgattgtaattgagcgtacaaccatagtcaaaaataaagaatttttgctacaataggtaaaacataaataaaaggaggaaaataatgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttactaatcctttcacgcgtggtattctttccacgcgtttttacatattcgacaatttctgcagcaaacgatccattgctcgatagcccaaggcctccgccaagtgcggttgagaaatttgttgttctccttgtagatcggcaatggttcgagaaactttcaaaatacgatgataagcccgtacagaaagcccaagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcacgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgtcccagtataatggcctgtagggcttggattcatcgctgccactaattgaaaacgagctgggaattgaatttttgcattggcacgagaaataataatctcaccactttccaaaggctggcgtagtgcatctaacacttttcgctcaaattctggaagttcatcaagaaaaagcgccccatttgttgctaaggatatttcgccaggtttagggatcgttccgccaccaactaaagccggcattgatgcactatggtgtggtgcgcgaaaaggacgttgcttccaattatgaaaatttaactcgttttgaactaaactcgttacagatgctgtttctatcgcttctaaatctgtcatttcaggtaaaatccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgaggggtaatttttcctgaccattgagaaattgcactacatctaaaagcgtttgagcaaaataagtattttgatcagacacgagcgaggcttcattagcattttgtttcgcgataattaactctcgctttgacttttgcgctgcaagaatagcgggaatcacaccatgtacgccacgcaattggcccgtcagcgcaagctctgccacaaattcaaattgctttaaacggcttgcatcaagctgatctgatgcagctaaaatcccgatagcaataggcaaatcaaatcttccgccttctttcggtaaatccgcaggggcgagattcactgtgatacgcttggctgggtatttaaattgtgcattcatcaacgcactacgcacccgatcttgtgcctctttcacggttttttctggcaaaccaacaagtgtaaatcctggttttccgttgcttaaatgcacctcaatggtgactagcggtgcttgcacacccatagaagcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttatttcgcaaaaagtggcgaaaaccaaaaatctaatttcgccgcccatttatcaataccaattttatttttgngcagtaaaaagcctcaacttgtatatcgcctttgaaacggaagaattgcttcacgcaccatttttactcgtttactacgggcgcttttgcttaaattaatcggctatagttcgcactaaaaccaccatgtaaatttgctgaaaccgcccattacatcattggtgtgcccacactctttcagcactggcaccaactgtccatcgagcattactttcttctgcctttatttcccactactcgtattactttacctctctatccatctcactcatttctctctgctccccgagttctttatgtgtcccacattcttaattctttcactcgacttcgtcngagttcgtatttctatatcctcgctctatgttctattctgtccttaatgcccatcctctggctatggtcgttttcctttccctcggtgtatctatatcttaattccttcatccccctctgtatattcatcgtcatatgttcaccatctttcacttcctgtt

SEQ ID NO: 504 - DNA, 5019 bp, H. influenzae
gcgttttagaaaaatgatgaaaaagcgaccgcacttgtcgagcgttctgcgaaagccattgctaatttaattgctgatttagtgattagtttagatattcaaaaaatcgcgattggtggcagtgtgggattagctgagggatatttatctttggttgaaaaatatttacaagattttccttcgatatattgttgtgaaattgaaaccgctaaatttggacaagatgcaggtttaattggcgcagcttattgggtaaaagatgttttactggataagcctgaaggaacaatttatggctaaattgggaaatgtgttaaacaaaattggctcactttaccagagtttaactaaatcagagaaaaaaattgccgatacgattttgcgttcgcctgatttagtctctcaatgctccctttcagaaatcgctaaacatttgcaagttggagaagctacgctcgtccgtttttgtcgaaccattggttttaaaggtttcagcgagttcaaactagagctttctattgaacttgcgacgaaagataatcaagatgaaagcatacttgaaacagaaattatgccaagtgatgattcgctcactattgcacaaaaattgcaaacggcggttgctaatgtaatggaagaaacgattaatttacttgatttaaaacagcttgaagaagtcgttaaagtacttaaaaaagcacgccgtatttttttatttggtgtgggttcatctggcgtaacggctgaagatgctaaaaataagctgatgcgtattggttttcaagtggatgcttcaggtaataatcattttatgtatatgcaggcggcattattgacctcttctgatgtggcaattggtttaagccattctggttattctgctgaaacggcacataccatcaaaatcgcaaaacaaaatggtgcaacaacagtggcattgacgcatagtttgcgttcccccgtgacagaatatgctgattatgttttggtaaatggtaataaacaaggcaagttacaaggcgattctattggcaccaaaattgcacagctttttgtattagatttaatttatgctttgttagtgcagggcgaagaagaaattgccgctcaaactaaacaaaaaactctcaatgtaattcttgaacaacgtataaaataggagaaaacttatgcgtgatttaaaaggtattttcagtgcattattagtgtcatttaatgaagatggcaccattaatgaaaaaggtttacgccaaattatccgccataatatcgacaaaatgaaagttgatggcttatatgtgggcggttcaacaggcgaaaactttatgctttcaacggaagagaaaaaagaaatcttccgcattgcaaaagatgaagcaaaagatcaaatcgcactaattgctcaagtgggcagcgtaaacttaaaagaagcagtggaattaggtaaatatgcaacagaattaggctacgactgcttatctgcagtgacgccattctattacaaatttagcttccctgaaattaaacattattacgacaccatcatcgctgaaacgggcaacaatatgattgtgtactcaatcccgttcttaactggcgtgaatatgggcattgaacaattcggtgaactttacaaaaacccgaaagtattaggggtaaaattcacagcaggtgatttctacttattagaacgtttgaaaaaagcttatccaaaccacttaatttgggcaggttttgatgaaatgatgttaccggcagcctcacttggtgtggatggtgcaatcggttcaactttcaacgtaaacggcgttcgtgctcgtcaaatttttgaattaaccaaagcgggtaaattagccgaagcgttagaaatccaacacgtaaccaacgatttaatcgaaggcattttagcgaacggtttatatttaaccatcaaagaattgcttaaattagaaggggtggatgcaggttattgccgtgaaccaatgacatcaaaagcaacagcagaacaggttgcaaaagcaaaagacttgaaagcgaaatttttgtcataaatatttaaattagaaaaaacttaccttcctctgtttattccgttacaaacagaacaacaagtcagcaagcacttgctttcctctgttattccgttacaaacagaacagcaagtcagcaagcactttccttcccctgtttacgggggaaggtgcccgaagggcggaagggggcaacttctattgctttgtcgtaaattattggagcaaaagaatttctttttaaaaacaagatagaaaattaccgcacttataatgatcctttggtgaatggtgggctaaagtccagcctacgatatgaataggatcattacggtcaataataaaggaaggctaatatgcgttttattccattacaaacagaacaacaagtcagttgttgggctgcacaacatatcatcaatcgtatcaacgattttaaacctaccgccgagcgtccttttgtattggggttacctactggtggtacaccactaaaaacttatcaagaactgattcgactttatcaagcaggcaaagtgagtttcaaacacgtagtgactttcaatatggatgaatatgtggctttaccagaggaacaccctgaaagttaccacagctttatgtataacaattttttcaatcatatcgatattttacctgaaaatatcaatattcttaacggcaataccgatgaccataatgcagaatgccatcgttatgaagaaaaaattaaatcctacggcaaaattcatctgtttatggggggggttggcgtagatggacatatcgcatttaatgaacctgcttcttcattaagttctcgcacccgtattaaaacgctaacgcaagatacattaattgcaaattcacgcttctttaataacgatgttactcaagtgccgaaatatgctttaaccattggtgtcggtacattattagatgcagaagaagtgatgattttagcaacaggacatcaaaaagcactggcagtgcaagctgccgttgaaggcagtattaaccatttatggacagtcagtgcattacaaatgcaccgtcatttcgtgcttgtttgtgatgaagctgctcaacaagagttaaaagtgaaaaccgtgaaatattttactgaattagaaggctcggttgctggtacggattatcaggataaatagagatctattcttcatctttatgtaggggcgaattacattcgccctataatcacaaacaatcatagggcaaattgtccttacgtttaagagcaatatagttgctatgttaaactgatgttgatattaggaacagaatatgaaatacgcattaaccaacagtgtgatctacactaaatacgaaattctacgagattatgcggtagtaattgatagcgaaactattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaagggccttatctcagcattgagaaaaaaggcgtacaccgccccgaatatattcgtgaaattacgcctgaaatgaaagattttctctgtgaaaatggcgatgtgattacaaaaataaccattgccgcagaaaacccaaccattaactatacgcctgattttgtgaaagcgggcattattgtctctgtaggtcattctaatgccacttatgaagtggctaaagccgcattccacaaaggcgcaacatttgcaacccacttacataatgcaatgtcgccaattagttctggacgtgaaatgggcgtagtgggcgcagtattagattctgatgtttacactggcattatcgtggatggtgtgcatatcaattatggcaatgttcgcattgataaaaaaatcaaaggcgacaaactttgtattgtgactgactctattgcagcggcaggcgcaccgccagaactagaaaattttacctttgtgggaaaaacaatttatatcaaagatgggcgttgctatgatgctaatggcacgattgcaggggcatcaatcacaatgatggaatccattaaaaatgcggtagaatatgttgaaattcctcttgctgaagccattagaatgagtaacctttatcctgcacgagcaattggtatagatgatcgtttaggttcggtagaaaaaggtaagatagcaaacttagcagtgtttacgccaaattaccaagtaatcggcacagtagtaaacggaaagtggaaagagaattaatagtaaatacttaaatagctaattgatttaaaaatctgtgatatatgtcacagattttttattaatattttgttacttataaaatagcctaaatatttatacacttttaacttaatcattttttaacttgattttaagcaaaaaaagcgaatctttcgattcgccttgcttttaataatgtatttctaacaaatgattagaagtaaacgcgtaaacctacacccactgatttttctttttcagtttttacgcctttagcttgctcagttgttctagttctagcgtaagcaccttcaatataggttaatacttgtttgtgaagtttatgatctacaccgaataacactgcttgttcacgtgtttttttaccttgatctacagaatcgcgttcatatttgaagttgccatagacattagtatcttccattaattcatattggaaacctggagatacgaaatagctttttatcgtgtttatctttatagtttttagtttttgcatagccactaatagagacactatagagggtaccgagct

SEQ ID NO: 505 - DNA, 4598 bp, H. influenzae
  misc_feature (2555)..(2555): n = a, c, g, or t
  misc_feature (2564)..(2564): n = a, c, g, or t
  misc_feature (2567)..(2567): n = a, c, g, or t
  misc_feature (2576)..(2576): n = a, c, g, or t
  misc_feature (4424)..(4424): n = a, c, g, or t
  misc_feature (4442)..(4442): n = a, c, g, or t
  misc_feature (4446)..(4447): n = a, c, g, or t
aatcagctttaatcagcacagcatgatgccccaacccttcgtcaaaggtttgagcaatttgatgataaattggcattagccaagggtaaagtgcggtcatttttcctgaaatttttgtaaataacgagggcaattatacacattttcaaactggcttgacaaaatagcaaaaagcaaacgtttacttttaataaataagaaataaatagaaaaaatttgaaccaaatggtatttttttgttcagttttatactagaattcacgccccatttatttttacttgacaaaggaaaatttattatgaaactcgaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaagtttagtagtaacaaaaaatcggcaggaaaattttctgccgatttttttattctgaaagtgcggtcatttttcgtttgatttccaccaattttttaccgaattttcaattccagccaatgtagggtgggcgtaagcccacgggtattattaataccattctttttttngtgggcttncgnccccccttncccgactaaccttacaagctacattcaatcgccaaacaggcaaacatcatcacgctaaacaaggtgcgctgaatttacagtggacgttttaagttaagttgtaacaaaaaaatcggcaggaaattttctgccgattttttattttaaaagtgcggtcatttttcgtttgatttccaccaattttttaccgctctttcgatatcagcttgaacaagttcaatactctgctcagcattaattacgactgcttttggattctcttttactaacgctaaatagcgtgctcgagtgcgatggaaaaaatctaaatccatttgctcaatacgatctaattcaccacgtccacgagctcgcgctaaaccgacaattggatctatatccaaataaattgtgagatctggctcaaaatcacctaatacggtttctttcaaagtaagcataaaatgcggatctaattgacgtccgccaccttgatacgcctgagatgacatatcgtgacgatcgcccaccacccatttcccttgcattaacgcaggtttaattatgttatccaccaactgaatacgagccgcataaagcattaataactctgctttatctgtcacgggttcttcggtttcatgtttgatgagatgacgtaatttctcagccagtggcgttccacccggttcgcgtgtaaacacgacatcttgaataccaagttcatgcaagacttgcacaacagactgatgagcggagcttttccccgcaccttctaagccctcaatgacaataaactttcctttcatattttcttccgcacttttatttggcatttttctggctgcgataccagcgtaaatattcttgcaccgctttgttatgttcattcaaatttcgggtaaatttatgcccaccagaaccatctgccacaaaataatagaaatctgttttttcaggttttgcaacagcctgtaacgaactttcacttggcatagcaataggcgttggcggcaatccatcaatcacataagtattataaggcgttggggtttctaaatcttttttacgaatattaccgctgtaattctcacccataccataaattaccgttggatccgtttgtaatttcatttttgcttttaagcggttgataaatacagaggctacttttgccctctcattagcaatacccgtttctttttccacgatagaagccaaaatcaacatttcataagggttcgccaaaggtaaatcctcgtcgcgctcgttccaagccttatttaacgcctttttcattcgctcagccgatcgcttaagtagctctaagtctgtggatttaggcgtataattataagtatcaggataaagccaaccttccacattttttagttcaagattttgaccaatatcaggcaagtcaagtaatgtgaaaatttcttcgttactcttatctttcaaggtttgcaccaagtgcggtgcattttcaagatcttttcgccaatctttaaaggtttttccttcaatccattttacattgaactgcacttctttaccggaattgagcaaatccagtaaatcttgcacagttttaacattctcaagagaataagtccctgcttttattttatttagctcaggtttcaacttaagcaaataaggcaataatttcccatcatcaattaacttttcttgctcaaaaagtgcggctaattttaaacctgttgtgccacgttcaatagttaaaagttgatctgcctgcacatttactggtgtttttacaaattcagtcattttgtaataagcaaaactcgccacgcccgctaaaataaaattaaaagtaaaatcgcaattaaaaaattcttcatnagctataagaaagagaanatannaaacaccaaaggggcaattaagcccctttatttttgatactttggtatttattaaaatactgaatattcgctcttttacgcaatgcttttacccaatcgttcgtcgcatcttggaatttgagaatttactaaacgttcatatgcttttggg

SEQ ID NO: 506 - DNA, 5070 bp, H. influenzae
caggtatacgaatatcggactcggtacccctcatttcttatgaaatggttttgactattaaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagaaatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaatcggcaatattaagccatttaatgttcccacaaagactaataccgcagcaggcttttccacagtgactaaaacaacagtagaaatcacaataaaagcataatccaacgattacgattgcgttcaatggttggacaaagggtcgttaagaaagaaactgaagtataagccgcaccaataacagatgtgacagacgctgcccaaataaccactccaaataacacttgaccaaaattgcctgctacatattcaaaaggcgtttcagctggatttttaggattaagagacacaccttttgacaccacgccaagcaccgcaagaaataatacaacacgcattgttgaagcaattaaaatggctgatacagaactacggctcacttcagccattgctttttcgccttgaatgcccgcatctaataaacgatgcgcgcctgcaaaagtaatataaccgcctacggttccccccactaatgtaacaatagcaataggatcaattttttctggaataaaggaatgatacgctgcttcagccacaggtggttcagttttaaacattacataaaatgtgagcgcaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaactcgctaataaagtatttgtaaaggttgcggtttgagttaaaaatccagggcctatggcggatgtcgccattaagaaagctgcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattacacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgtgcaccaatacgcaccttattttctttcgcaaatttgaccgcactttgcatttcctttgcgcccccagcgtgtaagccacaagcaatatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacactaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggtgcaataccaatttcgctacgcaaaatatgatcatttgccgtttgtagttgatcgcccgcctgcaaacaacgcccctcaatgccccctatttccgctctcaaatccgtgctgcaagaattcaatgcttgaggcaaaacaaaaccaccttgaacacataaataaccatacattccaatttttgcacgtgtcatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtggcgcgggatttcacatcaagaatatcaatcatagttcaatcccatccacaataaatttcacagtatcgccagcttgtaataaggttggttgtgcttgatttttatcaaaaagtgcttgtttagtataaccgatcaactgccacccacctggcgaagaaaaaggataaatccccgtttgcgcacccccaataccaacagaaccagcaggaacaaccgttcttggcgtggcgcgacgcggcgtgtgtaaattttcaggtaaaccacccaaataaggaaagcccgcttggaagccaatcatatacacagtataaataggctcactgtgcatctgaataatccgctttggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctcttttaaaggatatttataggttttgtcaagtctttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgagttgcttctttcacttctgtgagtttcactttcacaatgtcgcctattttgtaagtgcgttcgcctttaatataaagggcaatctcatctgaattcacctgcatttcttctttattattatgtaaagtggacgcaggtataaacattgaggcgccattttctaataattgcacacgtaatccaccacgcattacatcttgcacttctgcattaaattccacattttcagccacttcggtgcaagataacggcaatatagccaatctgcaatatcacgttctacgaggcgattttggcggcgagcctcttgcaaacgtgccaacacgtcatttgtgttt

SEQ ID NO: 507 - DNA, 5360 bp, H. influenzae
ctggtatacgaatatcagactcggtaccccccattctacctgagtgcatatcacgataacgcgcacctggagtaggcatatcgaccgtaaacactaaagtagaacagcctgctgctttcgcacgctcaagtgcgtttttcataaaaccacgatcttttaacacataaagctgaaaccacattggacgcttaatcgcaggggcgacttcttcaattggacaaattgatactgttgaaagggtaaacggcacacctttattatctgccgcttgtgctgcttgtacttctccacgacgtgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcggcgcgccgcttcacgataatcgctagctgatgaaataatcatttttacctcttattcaataaaatagtgagaaacctgagaggcattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcacttgtagatttttatcatcaagtaaatatttgatccgtttagcaattgctgcgctcggatccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgctttactgtaccctttgtagctaataaaccaatatgttttgtctttgttatttctgatgcaggtttaatagcgggaacagtcccaatgataggaatctcaaaagcagctcgcaaaggcggaagcacaacagtactcgctgtattgcaagctatcacgattgcatctaatggataacgttgattaataagctgacacgccgctaaagtgcggtgaataatactttcttcttcgcgttctgaataagggaatcccgcattatcaaagcaatagagataatgccaattgggtaataattttttagcttcacggtatacgctaaacccacccactccagagtcaaaaaaaagtacagttgggcgtttttcttttttatccatttaaaactctttgaaaattgaccgcacttttaagcgttcgagtaaatttctttattattgagccagcgacagattaggctttctgccacatcagggtatttttggataagtgatttcgcataatgttgcaccgttggtatcatttttctatctcgcattaaatttgctattcgcaattcagcaattcccgtttgtttcgttccaagtacttcacctggcccacgaatttctaaatctttttccgaaataacaaacccatcttggctatctcttagcacttgcaaacgcttttgcgaaactttacctagcggaggtttatacattagtacacaaaaagaagccgtgctgcctcgaccgacgcgccctcgtaactgatgaagctgcgataaacctaaacgttctgcattttcgataatcatcaaacttgcattcggaacatcaacccccacttcgatgactgtcgtcgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagcgcgacgttcttcagaaaccactacggttgttatcggcgtacgacctggaggcaattcatcaataattgatgtatccaaatctgcatatacggtcattgccaacgttctcggaatcggtgtggccgtcataattaactgatggggatgaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcacggcaccagttttgattttttcaagctctgcttgtcttgattttccttttactttacctgccaaccagccaacttcaataccgaaaggctcaaaccaccgtctaaaattattcgcatgctgttctgcaagaatttctgttggcgccattaaggcgacttgtttgccattatcaattgcagttaaagcagccaatgcggcaaccaatgtttttcccgagcctacatccccttgcactaagcgcatcatcggataatctttgataagatcttgttcaatatcggacactactcgcttttgcgcattagttggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaaccttgtcgagtaatgtcaaagcctgatccgttaattttcgtaatgaattttgttttaacccctccgttgtggaataaatcggcgttagggtttcttccaatactatgggcgcattatctcgcacaatttgatattctggatgatgaatttctggcatatggcgaccacgtttcacttcgccaaaggcctttactcgcacacctgcttgaaaactattacgcattcccgcattaaaattgaaaaaacgtaacataattttcgatgtgccgtctgacaaacttaccgataaaatcgggcgacggccaaaagcgacttcacaggtttgtacaattccctctatagtaaaatattgttcagggcgaagattagcgattggcgtaattcgcgtacgatcttcatagcgaataggtaaatgaaagagtaaatcttgcagattctgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccatttagccaacgattgacgacaagcatttttcaaacttgcacaatgttgatggtgtaccacaactgtatttttttctgtacaacatcccacaataggatcacctaggattggatggcaacattgcgcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagtgctaatttgttgaatagaaaaatcacctaaattatgcggctgcaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaataatattgactgtttgccctgattcaagggcttttgaaagtggataaggtttatgctcaacagtcacgccaacacaagtattccccacatctgaatgcacagcataagcgaaatctactgctgttgcgcccattggtaattcaacaattcgaccttttggcgtaaaaacataaatttctttcgggaaaaactctgattttacattctcaataaactcaaacgaattacctacactttgttgaatttcgaccaaactttgcaaccagcgttgtacgcggatttgtgcggttgtactatcgtttttaccattttctttataaacccaatgcgcagtaatgcccatttcagcgacttgttccatatcctcagtatggatatgaacttctacgggaactcctttcggcccaatcattgaagtttgcaaagattgatagccatttgctttaggtacggcgatataatccttaactcggcctggacgtggcttataaagattatgcatttgccccaaaatgcgataacaatcatcaacatttttcacaatcacacggaacgcataaatatccataatagagtggaattcttgatcctttatacgcattttttgatagatcttataaagatgtttttcacgtccccacactcgggcaaaaatgcctgcgttttctaaccgcactttaatctcttgtgaaatacgttcgattaaatcttgtcgattactccgtgccacatcaacgagtttttttaacacctcataacgatgtggatgcattgcttgaaaagataagtcttctaattcatttttgatatgctcaatacctaaacgatgagcaagcggacaatagatttcaagcgttctttcgcaatacggcgacgtttatctggtcgtaacgaaccaagcgtgcg

SEQ ID NO: 508 - DNA, 5365 bp, H. influenzae
atccccaccgctgttaatcaaatcataacgacgaattggtgctttcatatacactttatttgaccaagtaatatcgtaatttggtatcgtcatatcaatacctaaacgagcaatccaatcttcagtgttactattaacttgtcgtaacatttcacgataagtcattaatttaccatctaaagaaacaagtttatttagatcaaattcttcgccatcagctcgttttgtatttaaccaatcaaaaccaagtgacgtagtccaataagttttacctaatttccaaggttctatattgttaagttggaaagtataaatatcaacaccgaatggacgtccattgatataactagtttttatgttttcccttatagtctctcgtttcaatatgatacgatttttattatcacgatgaatataaccgagtttcagtgctaaattacccatattttggtcaaaacttaaacttaattcatctgcataagggctttttagggatgaaaagttctgatgctgacgtgttggattattattaagctttaaaataccattcgctaattttaacgaagcaaaagaacgaccgtaataacgatttaaacctagtgtaaatcctgtattatcccaaggtcggtaacgtgcaacaaaacgcggggcaatattattgttttttaaataatcattacgttcaatgcgaatgccaggtcgaaattcaaatttacgccatttaattaaatcttcagcataaatagcgatattttgatagctggttttaacacgacttttggtgttgtacttttatctgatctgaaaatattcatactcccatcactttgcaaagtagataatgttatttttgaatgaacatcttgtggacgatagaattgatatttagttgcctgataaattccaccaatagaaacagaatgctccgtagaagctaaataaaaaggatccattacatattcagtagaaaaatgtaaattatcttgggttaaacggctattaccatgcccgcctttttcaaaattataaagcgcttcataatattcatctaacacagatgttgtttcaacactatttgaggatgatttacgcttatctttaaaacgatcgtatgctaaggtatttgtccaaacgccagagttgaatgaatgcacccaagctagtgttgtccccaatgcttgatgataatcgcttacgttgttatttatattttcctggaaatatttcaattctttataatttgaataacgtaaaccgagttcaatacgttctttttcttgcggtgtccaattgaaatttaataaaagattatcggaaagtcgttgatgattttgtttgtctaactgtgctttattattggcattttgatcaaagccaattaaacgattttgttcaatagatgatgttctacggctatagccaaaaaccattcctaaattatcatttagccttttttcagccaaaatattgaatgtttgtttatcatatttaggttgtagctctgccactccgacaagatctggtcttacttgtttaagtattttttgtactgagtctccagcttccatttttgcccaagaggaatttgtcgtgcgatatttaagttttatgctatcagtgccgctatattgttttgttttggctataacggcaccccccataaatccccctaagctagcagaaatattactatcttgtacctccactttagaaagcatagtcgcatcaaagaaataagcttgagtgtgactaattccgggtacaacttgcatagaaccatcaaaaatatcgctatcagcagtaagttcattatttatattgacattatcaacaaaataagcagtttgatttggatcggcaccgttaattgaaatattttcaggcttgatttctccacgttgaaaaccatcttggtcgctattttcataacgaatatggggattagaacgaagataatcagtgatattaccgtttgatgtaggcgttttacttatctcgtcagaagagagtgttttaacggaagaaagtgatttattattgtcgccatacacaacaatttcgggcaatatatttttgttggttgttggttgttggttgttggttgttggttgttggttgtttcaatagttttccccataacaaatggactaacaaatgttgtgcagaataacaacattaatggctttttttgatacatagtatagttccctaaaataaaagatataaataagaatgattatcattatatttttaaaatttataaatgcaaggggaattcgacttaaaagaggtatcaaagaaataaaaaaaccgcacttttaaaagtgcggttatattcaattctgttttatggaagaaattattctacgccaaccattacagaagttgctttgatgattgcgtatgcttctttaccaacttctaagtttaattctttaactgcagctaaagacacagtagaagaaagcacgttaccgccaccgatatcaatgtgaacgattgcatttactgaaccgttttcgattgaaacaactttaccttttagttggtttcttgcactaattttcataacatttccttgttagttagggtttaaaagagcctgtgttttatcttacaaaaaacaagtcgttaataaactaagcgtttaaaacttttaaaaaattgaccgcacttttataggcattttgcaggtttcggcaaacctgctaattttgtagcttgttttgcagggccttcaggaaataagcgttgcaaatagcggctattacctttatctgcaccaagcttttcagccatggcttttaccaacatacggatggctggagaggtgttatattcttgataaaagtctcgtacaaagtaaatcacttcccaatgggcatctgttaattcgatactttctaaccgagcaatagcacgagcgacatcttcgttccattgttggctgtggagcaaataaccatctttatcagtttcaacttcaattccattgatattcaacatattaatttacttctttaaagttaatcatttcgttgtttgaaaaatcagtttgatcttcgtcttcaaattgcattggtgtgattttttcttcatcaaatgctgtatcgccttcaatgccatcaattagttgtccatgtttgattcctttgaaatcaaataatttcggatcacacatatgtgacaatgtaatgttttgcattgcactgaacatggtttctaagcgtcccggatattggcgatcccaagtattaagcatttcttttacaacttggcgttgaagatttggttgtgagccacataggttacaaggaataatcggaaattccttcgcgatggcatatttctcaatgtctttttctttgcaataagcaagcggacgaatcacaatttgtttaccatcgtcagaaatcaatttaggtggcatggatttcattttgccgccataaaacatatttaaaaatagggtcgctaacatatcgtctcggtgatgtcctaaagcgattttggttgcaccaagttctgtggcagtacgatataaaattccacggcgtaggcgagagcagagcgaacaagtggtttttccttctggaattttttctttcacaattccgtaagtattttcttgtacaattttgtaatctacgccaatgctttctaaatattcaggcaatacgtgttctggaaaccctggttgtttttgatcgagattcactgccacaatatcaaatttaatcggtgcattttgctgtaaattcaacaaaatatcgagaagcgtataactgtctttgcctccggataaacacaccatgactttatcgccatcttcgatcattccaaaatctgtaatggcgttgcctacgttacggcgaagacgtttttgtaatttattaaaattataggtttgttttttttcttgttgggctaactgggtcattctgttatctttagttattcatgaaagtcgcacattatacgtgaaaaataggaaaagtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgctgcgtgaagatgatgctttaggggaattaccagaagaattgcataccaatccctttctgatttacaccatcaaattgtagagcatatggcaggctttactgtatgtttatcgttgaaataaccggcccaatgattcgagtttaccgtcacaagaacaccggcaaaattatccctttctttgtattctgaagcggcccaataattgttgatcaaaccacacccttggtaggcgtaagatatttatccgcttttttcccattggcagcc

SEQ ID NO: 509 - DNA, 5458 bp, H. influenzae
tggtatcgaatatcggactcggtacccaagtatgcacaaaccaagctgaaatcgaccaaatcatgatcgatttagacggaaccgaaaacaaatctaactttggtgcaaatgcaatcttggcggtatctttagcaaacgcaaaagcagctgcagcatctaaaggtttaccactttacgcttacattgcagaattaaatggcactgctggtgtttattctatgccattaccaatgatgaacatcattaacggtggcgaacatgcagataacaacgttgatatccaagaattcatgattcaaccagttggtgcgaaaacattacgtgaagcacttcgtatcggtgctgaagtattccacaaccttgcaaaagtattaaaatctaaaggcatgagcactgcagttggtgacgaaggtggtttcgcaccaaacttagcctctaacgcagacgctttagcctgtatcaaagaagcagtagaaaaagcaggttatgtattaggtaaagacgttactttagcgatggactgcgcatcttctgagttctataacaaagaaaatggtatgtacgaaatgaaaggtgaaggtaaatcattcacttctcaagagttcacacactatcttgaagaattaactaaacaatacccaatcgtgtctatcgaagatggtcaagatgaatctgactgggaaggttttgcataccaaactaaagtgttaggcgaccgtgttcaattagtgggcgatgatttattcgtaactaacaccaaaatcttaaaagaaggtatcgaaaaaggtatcgcaaactctatcttaatcaaattcaatcaaatcggttctttaactgaaactttagcagcaattaaaatggcgaaagatgcaggttacaccgctgtaatctctcaccgttcaggcgaaactgaagatgcaactatcgctgatttagcggtgggtacagcagcaggtcaaatcaaaactggttctatgagccgttctgaccgtattgcgaaatacaaccaattaatccgtatcgaagaagcattagaacgcgctggtactccagcagcattcccaggcttaaaagcggttaaaggtcaagcgtaattcacgctgaatttactgtaaaatctcaccgcactttgtataaaagtgcggtgtttttatatctaatatttaaaggaaagagaatgttacatttaactttagaggacgaactctttttaggaacgccaaagcaagtgggaacacattcgacagtatttgagcattttgccgtaatgtttgaagatgacggcgaaactggctatttttatgcgctcgatatgcgtcaaaatgctcaaccgatagtggatatgttgcacgtgtataatgttgattcaacctctaatcatcatgaagcacgcaaacttgaaatttgttgggatgagagtggttatttagccttgttgcttattaatggctatcctcatgctgtatttgattttgcccgtttagtcggctataacagcaataaatatccacaaccagatttaatgagtatgtggactcgtgaagaaattactaataaacaggctgagcaatggctaggcgtgaaaaccattcgataaaaattgagaacaatgaaaaagaaaaatcagattttagttagtttatctattgtggccttattaggaggctgttcagaagagcaagtacaacgtgatgtgtatcagtctttagacgattgtttagcggattggaaaaaaattgagctttgtgaggcagataaaaatactgaaagtactcagaaaactgaaactacaccacagcaggggcttggtttaaatattcgtgataatggtaatgcagaaagtgcggtaaaaaatccagctgaaaataatgtacaagctaatcaaagcgagaacaatgctgaatcaactgcaaaagctgaaagtaccgatccttctttaggagccgcaattgctggtggcgttatagggtatatggcggctcgtgcaattagtagtttccttggcccaagctatcatcctggaaatcgagctgtcaccacaccaacagggcaagttgtgcaacctcaaacgaatcgttctgttggaaaaccaatgctcgtgaaaggaaatgcaggaagcatgaatagcaaacctgtatctcgtggtggttttagtagcccaaataatactcatcgtagcagtgggggctaaatgaaacgtgtaactgggtttcctactcgaccaaatatggtgcaacagctacttaatgttggatttgattattataacttgccttccagtgatggatctcattattggtctgataatgttgcctatgaatttaccttagcggaaattgatcgcattgaggatacaactaatgaattgcattcaatatgtttagattttgcggcggatgaaattaaaaaaggcgattatgaaaattatcattttacggagttgcaaaaacagcttgttgaaacctcttggcgtaatcaagatccttatttatatggacgctttgattttggctatgatggcaacaacctaaaaatgtttgaatataacgccgatacaccaacatctttgttggaggcagcgattgtccaatggcagtggttggagcaaattgagggcttgaaacatcgtgatcaatttaactggattcatgaagaattaataaaacatttccaatttttgaaacaacaaagtggcaaaacagatttccatttgagtgccatgcaggatgctggccgtgaagattggggcaatgtggattatttagctgatgtggcttataacgcaggttggaatattcatcaattagcggtggaagatattggctataacagcgaaacaaaaaaatttgtagatttaaatgatcaacctattgaaatgttatttaaattgtatccgctagaatggctaagccacgctgagtttgctcgccatattacaacggctgaaacacgatttattgaaccagcgtggaaaatgttgttaagtaataaagcactattggcaaaactttgggcgcgttatcctaatcatccgaatttattgcctgcttattttacgccttttgaattaccaaaagatttattgatgtgggtgaaaaaaccattgttaggtcgagaaggtgccaatgttttctattatgagaaaaataatggtgtagaatttgcagcgaaaggaagcgaacactcaacgttttatgctaattcaggttatgtttatcaacaaaaatttgaattgccaagttttgatggaatgtatccaattatcggctcttgggttgtgggggatgtggcttgcggtatgggattacgcgaagattttactgcagtgacggggaatgatagccattttatacctcattattttgtgccatgatatatatttagcattacttaaatacaatatttaccataaaaaatggaagctattataggttatttttacattcaaatttttgaacgattacaaaatcgttcaagtattatgtaatgaattagtaatatttcattgaaaaaaatctgcaccctaatcagttaaaccttagcctaacttttgggtgcagattcattactactattatttatttaaaataattaactcgaaagattataacaatccaccttgacctaatgcaggatcagtatcacgagcttttaatgcatcttcaacggttaaacctaatgctttcgcaacgccttcaccgtatgcggcatcacaccagtggcagttacgaatatgacgatatttgatgaaatcaggcgcatcgcccattgctgctgccgtgttgttgaataatgattgtttttgatctgcattcattaagttaaataatgcacgaggttggctgaagtaatcgttatcatcgttacgataatcccagtgtgctgcatctccgttgatacgaagtggtggttcagcaaagtctggttgttgttgccattggctgaagctgtttggctcgtagtgtggcaagctaccgtagttaccatctacacgaccttgaccatcacgttggttgctatgaacagggcaacgtggacggtttactggaatttgacggtagttcacacctaaacggtaacgttgtgcatccgcatagttaaataaacgagcttgtaacattctgtcagggcttgcgccaatacccggaaccaagttacttggtgcaaatgcagattgttctacatcagcgaagaagttttctgggttacggtttaattcaaactcgccgacttcaattaacggataatcttttttcggccacactttggttaggtcgaacgggtggtaaggcactttttccgcatctgcttctggcataatttgtacaaataatgtccatttagggaaatcaccacgttcaatcgcttcatataaatcacgttgatggctttcacgatcacttgcgatgactgcagccgcttctgcatcagttaagtttttgatgccttgttgtgtatggaagtggaattttacccaaaaacgttcgcccgcttcgttccagaaactataagtgtgagaaccgaaaccgtgcatatgacgataacttgctggaataccacgatcactcattacaacagtgacttggtgtaatgcttctggtaataatgtccagaaatcccagttattagttgctgaacgcatattagtgcgaggatcacgttttactgctttatttaaatctgggaatttacgtggatcacgtaagaagaatactggcgtattgttacctactaaatcccagttaccttcttcagtatagaattttaatgcaaaaccacgaatatcacgctcagcatctgctgcaccacgttcgcctgccacggtagtaaaacgtgcgaacatttccgtttttttacccacttcactaaaaatttttgcacgagtatatttagtaatatcgtgtgtgacagtaaaagtaccaaatgcaccagaacctttagcgtgcatacgacgctctgggatcacttcacgtacgaaatcagctaatttttcattaagccataaatcttgtgcaagtaatggaccacgcggaccagctgttaagctgttttggttatcagcaacgggtgcaccgttacccattgttaagtttgttgcagctaagtgcgagaaaggacattgagaactcattgtagactccttgtgaagttaataaatttagtttagggtgaaatgaatttcttgcgtatcatatagaaaggtttaaacaatcgaaatctattaaattaatcaaaaaaaactattattaaagaaagtttaaaatctaccctaatattccaaattaccttacttgatttcttttaaaagacctgattttcaaccgccttttgtcgcctttatcccttttacgggtgcaaggttaatacccaccttttgtaatcctattgattaccgatattgagcaccaaatcttacggtaaaaccttccacggtatgatcttagccctcgcggaaaat

SEQ ID NO: 510 - DNA, 6306 bp, H. influenzae
  misc_feature (6298)..(6298): n = a, c, g, or t
tggtaccgaatatcggactcggtaccccgtggattcttctgcatagttgggctaactgccgtgcttgcatcagaatagaacaaacctgatttcaagtaagaaatctgcccaaataattccaagccttctacgtggaacatccctgtcggcaagccgatttcatacaaatgatgataagaaaactgcccttgatatgccaagttgtgaatggtgaacaccgatttcgcagggcgacctttgttgaacagatatgctgcacacaaacctgcgtgccaatcatgagcgtgtaccacttctgcacgccaccagctatctaaacctgtggctaattctgcccccacccaaccgagcaaagcaaaacgtttgtagttgtcgccgtagtcgttgtaataggcatcgtgataaggattgccttcgcgaccgtataagtgcggtgcgtcaatcaaatagatcccgacaccattatattctccataacgcaacaccacgtgcccagcgaagttgtcaaattcggcaaccacttgagtattctgaatgcctgctataattgcgggataagcaggcaataaaacgcgagcatctagcccaatttggttctgtgcttggggtaatgcccctaaaacatcggcaagcccgcctgtttttaagagcggatagagttccgaacaaacgtgtagtattttcattgagttttttattttccctataaatatgaataatgctcgatcagccccccctctttgctaaagagggattcagaaagtgcggttaattttgaccgcacttttcctaactaatctaaatgaccttcttcgccaatctcgtgtccctcaagtatctttagcattttcggggttacaagaatgactttgcctgttgagctaatacggaagcgatttttatcttcttccatatccacaccaatttgcataccatcaggaatttcgcattcgcggtcgataatacaatttttcaacacgcaatttttaccgattttaacttgtggtaacaccacgcagtgatcgacttttgaaaaggaatcaattttaatgcgatcaaaaagcacggaattgctgatcgatgcatcggtaatcacacagcccccgccaatcaatgagttatctactgggtgcacgttagagtgtttatagaagaatttagacggataagcctgaaccggattaccacgaattggccagctttggtcgtaaatatctaattgtggattttcagagactaagtcgatattagattgccagaagctatcaagtgtccctacatcacgccagtaaatttcgccctcggtgttgcgtcccatgcaagaacggctaaatgggtgagcataaagcgcgcctcttctaaacattttggcaatacatctttaccgaaatcgtggctggtgttcggggtgccaacttcacgatctaacattttgtaaagataatccgcatcaaacacataaatccccattgaagtaagcgaaacatcaggtttacccaccattgctggcggatcttttggtttttccacgaaagcttttactttcaagttttcgtttacagccattacgccaaattcgtgtgcttcagaacggggcacttcaatgcaaccaatagtacattttgccccactattgacgtgatccattaacatcacgctgtaatcttgtttgtaaatatggtcgcccgctaagatcaaaatatatttcgggcgatagtgatttttaataatagccatattttgatataccgcatccgccgtgccacgataccaagtagaatcgtcaatttgctgacgagctggcaacatatcgacaaattcccctctctcttgtggtaaaaaagaccatcctgtttgcaaatgacgaagcaaggagtgtgccgcatattgagtcacgaccccaattcggtttaaacctgagttaatacaattagaaagtgcgaaatcaataatgcgacgattaccaccaaaataaagcgctggttttgcacgtttatctgtcaattcgtgtaaacgtgaaccacgtccacctgcaagtacaagcaccaaagtgtttttaactaaatcatatttgttaaggtcgccagatttcataaggatctccatagtcttattgttattcgtcattcagcatacaaaagcccattgaactaagttcggcttgttcttcaagggttacattatgtgtgccgatttggggcttccatttcccattaggcaagtgaaacacctgaccttcggctttggcattaatcaacaaaagccaacgattgtctaaaaccacctgtaatgctttggtttgttgattttgccaatcttcaactgtcatcggttcgcctgcaatgttaagccattgcacattctcatccgaccaccattgatcttggtttaaactgcccattcttttgcggagtgcgatcgtttgcttggtcagttcaaataattcttcgttaaaatttgcccatttcagccaagtaatctcgttatcttggcaataagcattattgttaccatattgagtgttgccgaactcatcgcccgccaaaagcataggtgcgccattcgccagcaataaactcattaataatccactttgtgcaaaagtgcggttattttccaccgcacttttttgcggttcagaaagggattctgtagaaccttctactccgtggttgtaactgtaattttcgtttctgccgtcgtgattttcttcgccgttcgcttcattatgtttttggttgtaactcactaaatctttaagcgtaaaaccatcgtgagcggtaataaaattaagtgtagtatgtggcaagcggtcatttttcttaaataaatcgatagagcctgcaaaacgttctgcaaatgcaccgatttcgccacttttccatagccagaaacggcagagatcatcacggaatcggtcgttccattcggcaaaataacttgggaaattgccgacttgataaccgtaatgtccaatatcccaaggctcggcaatcaatttaatattttgtaaacttggctcattttttatgtcagtaaaaagctgagctgacgaattaaaatctggtgtatcacgaccaagcacggaggctaaatcaaaacggaaaccatcaatgtggcattgctccacccaataacgcaggcaatccaccacccactttcgccctacatcagaggataaattgagcatattgccgcagcctgtccaattgatataacgcccttgatcgttgcgccaatagtaagtttgatcatcaataccacgctggcagaatgttgggtaagtttgctctgattctgcagaatggttaaacaccacatctaagataacttcaataccctcattgtgaaacgcctttaccatcgctttaaattcagctaatggattatttgttgccgcatatttaggttccaccgcaaacatcgctaaggggattgtatccccaataattttgtaagcctcgtgcctgtaagtgcggttcatttatatggaaatttacaggcagcaactccaccacagttacgcctaattctttcaaatacgccaaattcacaggatgtgctaatccagtataagtaccacgcaacgccgcagggattttctcgttaaactggctaaaccctttaacgtgtaattcatacacaatggtttcagcccaaggcgtattgggtaaagtatcattttcccaattaaaatcttccgaaatcacaaccgctcttggggcaagatgcgcgttgtcgcgattatccgaaagcaagaaccaagaacaactttcttcgctacttaaatcaggtttaccatttacggctttcgcatagggatcgagcattaatttattcgggttggcaaattcgccgtgaatacgaaatccatattccgtaccagttttcacgccagttaccgccaaatgccacacattttcagtacgcaccatcggcaagcgtgtttcttgattttgttcgtcaaaaaggcaaagttctacgcctattgccgcagcggaaaacagggcgaaattggtaatttgcacgttgttttcgaccgcttgtgagtatcccattggaataggattgccgttgttgtagattttgaacatatttttatcgcttttgtaggggcaaatgacatttgcccaaaaacatcggtggtttatcagggcgaatgtaattcgcccctacaatttatctattcggattatttcgccttcaatctcaaataaactgttgctaacggcggaatggacactgaaatcgaattttctcgtccgtggctttcgattttttcacttgcgacacaaccaaaattgcccacgtttgaaccttcgtaatacatcgaatcggtatttaaaatttcttcgtattttcctgcaacattcacgccgatgcggtaattgtggcgaggcacaggggtaaagttactgacgacaataatacgttctccgtttgaactgcgacgttcaaaggcgaacacagaatttgccgcatcatcaacgacaagccaatcgaaaccctctggggagttgtcgagctcaaagagcggtcgatttttttgataaatttgattgaggtctttaaccagcttcaatacgcctttgtgccaacctccgccaatattttcatcaagcaagaaccagtccaaactttcttcataattccactcacgaccttgggcaaattcattccccataaagagcaattttttgcctgggtagccccacatataaccgtaatatgcacgcaagttagcgaatttttgccacgtatcgcctggcatcttgccaagaagtgaatatttaccgtgaaccacttcatcgtgagaaagtggtagaacaaaattttcgctgtattgatataccattccaaaggtcattttgttgtgatgatattggcggtaaatggggtcaagcttcatataagccagtgtatcgttcatccagcccatattccatttgaaattgaagcccaagccgccgtcttcgcttgggtgggttacgcctgcaaaagaggtagattcctccgcaatagaaattgctcccgccatttcgctgtgaattttccagttggtgtgttttaaaaactcaatggcttctaaattttcacgtccgccgtattggtttggaatccactcgccctccgcacggctgtaatcgcggtagatcattgaagccacagcatccatgcgaataccatctacgccaaagcgttcaagccagtaaagggcattgctggacaggaaatttttcacttcgttgcgtccatagttataaatcaaggtattccaatcttgatgatagccttcgcgagggtcttcatgttcatacaaggctgtgccatcaaatgcgactaaaccatgggtatcacttgggaaatgccctggcacccaatctaaaatcacgttgatgcctgcttcgtgagcacgttttactaaacggcgaaatgcctcaggtgagccaaaacgactggttggcgaataaagcccaagtggttgatagccccaagaaccatcaaacggaaattcagaaagcggtaaaaattctatatgggtaaagcccatctcttttacataaggaattaattcatcagcaatttgatcgtaatctagccaaaaattgttttctaaattacgacgccaagatcctaaatgcacttcataaatagaaatcggttgatttgcttgatttgcttgacgacgttgttccgtcatttccaccacatttggtaatgcactaatttgtgaagctgtatcagggcgaagttgcgaactaaaggcataaggatccgctttcaaacgaagattgccatagcaatcaatcaattcaaatttatagagctgaccaaggctggctttcggcaggaataattcccacacaccgcttttcgggtggaaacgcatcgggtggcggcgaccatcccaatagttgaaatcgcctacaatagaaactcgtcttgcattaggtgcccacaagcggaaattcaccccgctcacaccatcacattccataaaatgtgcaccaagcacttcatatgggcgaagcatagatccttcagaaagtagccattgttctaaatcgtcaatcattggatgaaaacgataaggatcttcgataatttgtgcttcattaccccaaaaaacctgtaattgataagcaaaaaattgacgacaatttggaataacaccaacaaaaaatccacgctcatcgacacaatccagttccgttatttctttaccactttcacgctcaatcaccaccattcgattggcatctgggcataacgtacggatttcaattccttgctcggnttcgtgct

SEQ ID NO: 511 - DNA, 8069 bp, H. influenzae
ctgttatacgaatatcggactcggtaccctaacctcttaattaacctaggctgatctgcacgtccacgccggcagccaaatctaaacgcattaatgcatcaacagttttttctgttggctctacgatatctactaaacgtttgtgagtacgaatttcgtattggtcacgtgcgtctttgtttacgtgtggagaaatcaacacggtgaaacgctctttacgagttggtaaaggaattggaccacgaacttgtgcgccagtacgtttagctgtttctacgatctccgcagtagattgatcgatcaaacggtgatcgaaagcttttaagcggatacggattctttggttctgcattagaccagagctccaataaaatttagctaataaaaaaactaacaccaatcacaattctaacttcaaatatagaaaaggaggtgcaagttacctgttatatagtctccaaatcggaaacattgttagcctgacatatcgtcatgcccgttcaataaatgattacattaaacggctctcatattgagagtccgtgtattctatagaaagacaaccctatttgcaagcttttattttaactattttgttggcctaaaagcctctaataatttatcaaaaatatattcttcaaggtgtgtgtaaaccgtttttctttgacgacatagtgtcactttccacggaacaggactttcgattttacgacacaaaaattcttttgaatgataaagctcagccataggtaacggtagaatagttaataattctttgtttgttttgaccgcacttagcagaaaatcccaacaactcgaatccaaaacaatatctggataacaattattgcgctcaaaagcttccttcaaatgatgatgaatcataaatgtttgatcaaaaattgccattttctgctgatgtaaatcagcccatgtgatttgttgtttttttgctaagacatgctttggtgaaagaaataaggctaattcagaactatgaatttcaattgaatcaataatattttttgatattcgctcgggatataacaacacggctaaatcaactttatctaaaagaagttcactctttagagcataagctccaatttctttaataataaaattaatatctggattcttaagaataagatgaggcaatacagaagagaacacggctgataaaactaagggaggaataccaattgttatcgtgcctttcttacaatcttttgatttataaagatttgttctcatatcattgtaacgcttgatcacttcttttgcatcacgataataattttcccccgcaaaggttagtccaataatttttcctgatgcccgtttaaatatctgaatattttcacgattctcaaactccgtaatcatcatacttaatgcaggttgagacacatataaattttgagacgctcggcttaaattaaaatcattatctacgattgaaacaaaatatcttagatgcctaatatccatcattttcacccccctaaggactgccatttttacaaaatatagcacaaggattgtttaaaacactatcaaaataacttatacccgcctaagaaagatgtatttcttttacgaaattttttttgctatttttaatatcaatctagttcctttattgcctatcaaggatcatccacagaaacatatccatttgaaatataagatacttatttgttgatattctttcttttaatctcgttattaggaggtctctatgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaataaggagaacgccatgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactttaattatgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaatttctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatagaaaaggagttaaaaatggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgcttataactatttacttcctaaactacaacagcgaaatatttcacttctaactaaaaaagcgaatttcttttaagaaattcgcttttcttttgatatccaattattctttcctctccatcatcgcaatatgccttgtcgcggcaatccacgccccaacatagcccataattaaacagcacactaataagaatacaaactcgccaacgcctaatccattcaaactgaattggacggcaaaaatatccgttacgtatttcactgcagaagtaaaatagctgataataaaactactaaaaattgctgcaactaacccacctaacacggcataaatcatccccgtataaagataaggacgaaggataaactgatctgttgcaccaagcaatttcatcacatcaatacttgagcggctactgtacacatcagagcgaatactgttaccaataactaaaaataccgctatcgtcattaataccgtacagaaaattgccacatgggcggttaaccaagaaagtgcggttaatttttccatccaatcattatccaagcgaacttcttgtacccctttgattttatttaaattggtacgtaactcatcacgtttttctgacacattaaattcgctcgtcggttttactatcacgaccgcaggcaatggattatcatctaaaatttccaattcttcgccaaagccagaccagcttttaaattcctttaaactttcttgacgagaaacataattcagtgattctacgcctttttgctggcggattttttctaccactaaattcgcgttttcctcacttaaatttttatgaagataaatagtcaattcactgtcaggataaaattgagtggtggctaaatgcaaatttttccacattaaatagctcacagtcgggatcgtaagcgaaacggcaatcactaaaatcgtgagcagcgtgccaaatttacgttgccataaatccgcccatactgcacgcaaagtataggctgtttgaacaaaaacagatgcatccgttgatcggctcatgattattccttaataacgtaaataaccttgttcaagcacaagacaaggttttggtttttgttgaattaaattaatgtcgtgagtagcgattaacacagtcattcctagacgattaaattcttcaaacaaattaaaaatgcctaaagaaagttcatcgtctaaattacccgttggttcatctgctagtaagagctgaggtttatgcacaatcgcacgcgcgatatcaacgcgttgctgctcaccgccagaaatttgtggtggcaaatagtgggctttattacgcaatcctacacgatctaaagatgccatcgcacgtgtatgcgcatcttttggatgcatacctgcaataatcaatggcaatggccacattttccgccactgtacgatctgttaataaacgataatcttggtgaaccatgccaatttggcgacgcaaaaatggaatttcatattttgacaagcgagtaatatcgtgtccgttaaaccaaatctgaccagcattggctttttccatccccataataagcttgagtaatgtacttttccctgcgcctgaatgcccaactaagtaagtcatacttcccactggaagatgaaaattcaagccttgtaaggctggctgcgttgcaccatgataggctttagaaacatttgagaacttaatcacaatttttccttattctttttattcttcttcatgaacgaataatgcctcaataaattctttcgcattaaactcacgtaaatcttcaattttctcgcctacaccgatatagcgaataggcaacttaaactgatcggctatggcaaaaatcacgccaccttttgccgtgccatctaatttagttagagagatccctgttaaacccacagcctcattaaataatttcgcttggctaatagcattttgtcccgtgccagcatccagcgtaagcataatttcatgtggtgcagtttcgtcatattttttcataacacgaacaatttttttcagttcgtccattaagttatttttattttgtaaacgacccgccgtatccgcaataagaatatcaatattgcgtgcagccgctgattgcatcgcatcaaaaatcacagacgcagaatcagaacccgtgctttgcgcaacaactggaatatgattgcgttctccccaaacttgaagctgctcaacagccgctgcgcggaaagtatcacctgctgcgagcatcaccgattttccttcagcctgaaatttacgtgcaagtttaccaattgtcggtcgttttacccacgccttttacgcccaccattaaatcacataaggttttttggggctatcaatctctaacgggcgggctactggctcaagatatccgccattctacttttaattgttgaataaaagctcggcatctgtaattcttagacatgcctgttcagtcaaat

SEQ ID NO: 512 - DNA, 6125 bp, H. influenzae
  misc_feature (6098)..(6098): n = a, c, g, or t
  misc_feature (6110)..(6110): n = a, c, g, or t
  misc_feature (6115)..(6115): n = a, c, g, or t
tgcagattccggtatttgccccccaataaaggcactgaaattttgatcgccccattcactaatacttttaatatcgttactcgtaagtaaaattgttgttccctgatttggttcatactggaaagtaaccaaaacctgtgacggcaggggtgattccaaaggtattgttgggtcatccgcgaatataaacgtgggcggattagcgacagccattgcgatcaaacctttttgtccttcgccttctgtcagttcgttaggatagcttgccataatatcacgatgatctttaattcctacgcgatgtaacaattcaatagcacgtctttttttccacccaaaccatttccaccatttatttttaaatgtccaattaggaatattttggatgagttgtttccctatttttcgacttggatcaaggcaagataagggattttggaaaatcatggatatttctttgccgacaatcttacgtcgtttattaggactgagttttagtaattcgatatcgtgaaaacgaaagcgatcggcagtaataatccaattttctttgattgcattacaaatgactttagcgattaagctttttcctgagcctgattcgccaactaatccactgatttccccttcgttaagggaaagattgacgccatctacaatttttatacgtccattggaggtttgaatttcaatattgaggttacaaatgtctaaaagtgccataggctattcttgatgttgattgatggctttagttaagccattactgaaaataatacttaataaaatagtaaaaataatagcgaaaccgggtaaaagtactgtccaaggtgcaagataaagtagttccaaagagtcttttatcattgccccccattctggtgtaggtcgttgtgcaccaagagaaataaaacttaatgcgctaatatccaacacggctataacaaaagcatgagccacttcttgaatataaataacagtaatattcggtaaaatagtgctttttaataaggtttgattggaaatgccttcaagttttagcattacaacataatccttttctaattctttttgaatagcgcgatagatagtgtgaaatgaaataaggcaaaattgctaatagcgtagcaaacattgcattccataaacttggttccattaatggttgaaataacaacggcaattaatagaataggtaacgataaaaaagcatcaaaaatatgcccgacaaaacgagctttaatacctttcagtagtcctgcaataattcctagtgcgccgcctattattgccactgaaaagacaaccagtaaagcagaacctaaggtataacgagtacccataattaaacgacttaatatgtcgcgacctatatcatcagtaccaaagaaaaaagcaatttttcctctatctacccaagaaggaggcattaattcttgcccaataaattgtcgattatcagcataaggtgcaagataactagcaaaaagtgcggtaaaaattaatgcgattaataaataaaagctaaaaagtgcgatggtattttgacgaaagcgtaaccaaatttgaaagattgaggtgctttcgcggaattcatcaggttctttatcttgcataccaacctttctttttaaatggatcgagtataaaagtgaatattttagtgaatgtatcaatcaaaataatacatacaccaataacaattacacctgcggcaatgctgttgtaatcttgttcatttacggcattaattaaccaacgaccaatgccaggccaacctaaagccgtttctaccaacatacattgcgttaatactaatgtgaatacacgtggtacttgtggaacaagcaggggaaaagtattacggaatacatattgatggagaattttccattttgaccaaccccgtgttgtcgctactttagaaaaattttgattcaaaatatattctgctcgttgatgaataatacggataatttccattgttggcaaaatacacaataccaatgttggtaaggctaaatgttgcaatatgttttgtacgatttttgtacgataaggtacttccataaaccacatatcaataacaggaaatcccgtaatgggtttaatttcgtaaagcaaattatattgtccaatagcggcaatttcccaatgtgagagcgcggcaacatacagtaaaatgggggctaaccaaaatattggaatagatagccctacataagataggatttgtaaactttttgcaaaaacttgttcagaattgaccgcacttataatgccaagtggcaaaccaaaaataaatgccaaaaacaatgtaatgaaacaaagttccaatgtgggaggaagaaccgtaagaataaggttcattaatgattttccaccgttataggtaatgccaaaatcaccttgtaacaaggtgcctaaataatggaaatagccgatataaatgttttgtgtaacaagattcgcattaagaggatcgcgcaataaaataacaaagcctaatagcgataatacgagtaataataatgccacccacagaatatggcgaagaaccgaccagaacattagtgtttctcctgaataaaataaaaggtggaaaaatctaagctaccaaaaggcgtcatttttactcctttcacacgactatttgcgactaaaattcgttttacattggcaataggaataatgggtaattcacgtagaacgagttcttgggcttcattataggcttttgcgcgtgaacttaaatgtgaggtggtaatggcacgatccataaattgatcaaattcttcattacaccaattagataaattagtgagttcattttttgttccacagcttaaaattggacgcataaaaccatcaggatcaagattaccagctaaccaaccagatagaatcaaatcataattttccgattgattgcgtaattgtgcagttaaaaatggacgagttacggcacgcactttaactttcacacccgcttgagctaaatcccatttgatcatttcagccattttaaaaggtgctggattatagacttgttcttcattaattacccataaatttaacaaaaggtttttatctgctaatttatttttggcgattttgggatggtaatcaaactcaaattctggcgtattgacagttgaagcccaagacacttcaggaataatgttattagcaacagttgctgtgttatggtaaatgctatgaatgattcgagctcggtttaaactttgtgaaatagcagcacggatttcgtgatctcgcattaatggcttatcaaaattaaacgctaaataggctaaattcataccatcagtagattgcatataataatgtttgtcatcattttttaataagccaatttggcttacttcaggataagaggcgatttgacattcattattgaaaaatttgactaaacgtccgctgcgatcagtagaaagatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggtaacattcgcctctgctaaggttggtaaataagtattatgccctaatacacgattaatcgaaaatactacgtcttcagcgttaaaatcacgtgttggggtaaaccaaggggtttggtgaaattttacgccgtgacgtaaatttaataaaatttctttaccatcagctgaaatggaataagattgtgccagcattggtgttaatgttgcactgtgattttttatatcaaataatttgttataaatttgttccgtgaccacattcatactggttcctgcatctgctgtttgcggattaaatgaaaaacctgaagcgtgggtgcaataagttaagccattttcagttaaaaatgttggaacacttggcgcagcctgtaattctacactttggcttatacagagcagaaaagataaaaatctcagatttagacgtaacataacaaatgcattgtgataaattatgtgtcaaattgtaaggcatattagtaaaaatggctaggatattgaatgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggattcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaataaaaagtgcggaaaattttccgcacttttttcatctttctagcctgtattgcgcatcccagccgcgatacctgtgatggtaatcatcaatgcttgttccacatcgggattgacttgctctggattttcacggaaacggtgaagcaattccacttgcagtagattgagtggatccgtgtagatattacgtaatgcaattgaatctgcaatccaaggtaaatcagacatcaattcactttggtgagaaagtgaaagcacagtttgaatatcatcttcaagttgcttacgtaaattttcacctaaataccaaagctctttttcactaatcgttgatcatattgtgggaaaagggtnaccgaggcccgnaattncggataccat

SEQ ID NO: 513 - DNA, 7004 bp, H. influenzae
  misc_feature (5214)..(5214): n = a, c, g, or t
  misc_feature (5218)..(5218): n = a, c, g, or t
  misc_feature (5245)..(5245): n = a, c, g, or t
  misc_feature (5281)..(5281): n = a, c, g, or t
  misc_feature (5291)..(5291): n = a, c, g, or t
  misc_feature (5293)..(5293): n = a, c, g, or t
  misc_feature (6749)..(6749): n = a, c, g, or t
  misc_feature (6816)..(6817): n = a, c, g, or t
  misc_feature (6828)..(6828): n = a, c, g, or t
  misc_feature (6868)..(6868): n = a, c, g, or t
  misc_feature (6904)..(6904): n = a, c, g, or t
  misc_feature (6933)..(6933): n = a, c, g, or t
gagacccctacgagggtttgaatttgcctcattgctaccttttgacaaattcaattcctttgtttacgccaaaggaacgttcaaaagtgcgcttattatcctataaaaattgaaaagatcaaattcttttgaattttttgtttatttttcatccaaacaacacacttttcttgactcatttactccataaaacactccttaaaaatgctcaaaatctaattcgacatcattaacgccttaagatattatcaataacctgccatttttacctttaaatgagttaaatactatgttgccaagtctaaatcgcattcctcaaattgaacaatatgtacttgattatcttgatgatcttcaacaccaacattttgagggggatattgcgacaaattattcggatagattaagtctggctacggataacagcgtttaccaacagcttccacaggcgattctttttccgaaaactattgctgatatagtgcgtataaccaaattggcaaatttatctgaatatcaatcaatcagctttacgcctcgcggtggaggcactggcactaatggtcaatccatcaataacaatataatagtggatctttctcgtcatatgactgccatcttagaactcaatgtaaaagaacgttgggttaaagtacaagcaggtgtcgtaaaagatcaacttaatcaatttttaaaaccacatggtttattctttgccccagagctatccaccagcaatcgagcgactttaggcggaatgattaacacagatgcctcggggcaaggttcattgcaatacggtaaaacctctaatcatgttttggcattacgtgccgtattaatgaacggtgaaattttagatacaagtgcggtcaattctgttgatgttttagaaaacattgatgcgcttgaattaagtgagagcagcaaaagactccatcaaacaatcgcgcaacactgtaaagaaaaaagagcggcaatcattaaagatttaccacaacttaaccgttttttaacgggatacgatctcaaaaatgtattcaatgaagatgaaagtgaatttaatctcacgagaattctcactggttctgaaggttctctcgcatttatttgcgaagccaaactcaatcttctgcctattccgcagtatcgcacgctcatcaatattaaatatcgttcttttgacgcggcattacgcaatgcaccttttatggtgaaagccaatgcgctttctgtggaaaccgttgattccaaagtcttaaacctcgccaaacaagaatattatttggcattctgtgaatgaacttcttacagaagatgaaaaagatccaattctcggtttaaaatattgtgggaattttgctgggtaaataataaagaaaaaataggccgccaagtcaccgcacttttgtcacttacttgatgaaaaaatcgaacataaccaagatcacattattggctatcaagtttgttctgatttaccctctatcgaacgtatttatgcaatgcgaaaaaaagcagtgggcttacttggtaatgcaaaaggtgcagccaaaccgattcctttcgtggaagatacttgtgtccccccagaaaatcttgcggattacatcagtgaatttcgcgctttattagaccagcaccatttacaatatggcatgtttggtcacgtggatgctggtgtgttacacgttcgccctgcacttgatttatgcgataaagaacaagtgaaattatttaaacaaatttcagatgaagtggcagaacttacgattaaatatggtggattactctggggagaacatggaaaaggcgtgcgatcccattacggcgaaaaattctttaccccagaactctggtacgaacttcgttatatcaaaaccttgtttgatccgaacaatcgcttaaatcccggcaaaatctgtacacctttggattcccaagaggaactttattctattctttcgccaatgcgagctgataaggatcgccaaattcctatccaagtgcgtgatgaatttaagggtgcgatgaactgcaatggaaacggattatgtttcaattttgatgaacacagcattatgtgcccatcgatgaaagtcagtaaaaaccgtgtattttcgccgaaaggtcgcgcagcaatggttcgagaatggcttcgattgatggcgaatgaaaatgtttcgcccgcacaattagacttccgtaaaacagaaataaaactaaccgcacttgtgaaaagactaagcaatacggttaaaaaatggcgaggcgattatgatttttctcacgaagtaaaagtcgcaatggatacttgccttgcttgtaaagcctgtgcgagccaatgcccgattaaaatcgatgtaccaagtttccgtgcgaaattctttcatttctatcacagccgctacttacgccccgcaaaagatcacattgtggcaaatttagaaatcgctgcgccttatatggcaaaacaggcaaaattctttaattattttaccaagctaaaagtcacgcaaacattagtggaaaaaacgctaggcatgaccgatttgcccttgctttctgaacccaatttgcaacaacagctggtagaaattcattatcaaggcaaatccttggaagaattggaaggcctaagtgcggtagaaaaaaacgatattttatttattgtgcaagatccttatacctcttactatgatgcgaaagtggtacgagattttgttatgcttacgcagaaattaggcttcacaccaattctgttgccatttaaaccaaacggcaaagcaatgcacattaaaggtttcttaaaacgctttagcaaaacagcagaaaaccaagccgagtttttaaatcgaatggcaaaattaggcattcctcttgtgggcgttgatccagccatcgtgctgtcttatcgagatgaatacaaagaagcactacaagaaaaacgtggcgattttcacgttctcaccgcacacgaatggttaaaacaaagattacaaaatgcggatttacaagagaagttaaaaaacatcgccaaaactgaccgcactttcgattggtatttattccagcattgtacggaatctacctttatgccaaacagcccaaaagaatggcaagaaatttttggaagatttggacaacaacttaatgtagaaaaagtaggatgttgcggtatggctggtgtatttggacatgaagtgcaaaatcaaaaaatgagccgagaaatctacgatgtatcctggcacaaaaaactgcatgaaaaagatccgcacttttgtttagcaactggttattcttgccgcagtcaggtaaaacgttatgaacatgtggtgttaaaacaccctgtgcaggcattattagaaattttagcgtaatgaaaggaacatcatgatttggcaaaaaaacttcacgctcgaaaacttaaatcaactttgctccaacagtgcagttagccatcttggcattgaaatttctgcttttggcgaggattggattgaagcgacaatgccggtggattatcgtactatgcagccgtttggtgtattgcatggaggggtttctgttgctttagctgaaacaattggttcccttgcgggttcgctttgtttagaagaaggcaaaactgcggtgggattggatattaacgccaatcatcttcgcccggttagttcaggtaaagtgaccgcgagagccacgccaattaatttgggcagaaatatccaagtttggcaaattgacatccgcacagaagagaataaactttgttgtgtttctagattaaccctttccgtaatcaatttatgacaaaatccgcaaaaatcggcgtattacttgccaatctaggcacgccagatagcccaacaccgaagtcaatcagccgttatttatggcaatttttaacggatcctcgcgtggtagatttaccccgttgcaaatggtatccactgcttaaagccattattttaccattgcgttcaaaacgtatcgccaaaaattatcaagcaatctggacagaacaaggttcgcctttacttgccatttcacgacaacaaaaagacgcattacaagcctatttagatacgcaaaatatcaatgctcaagtagaaattgccatgacgtacggcaatccatcaatacaaagtacggtaaaaaatttgcttaaaaatcaagttgaacgaattattgttttgccactttatccgcaatactctagctcaaccacgggcgcagtatttgatgctttcgctaatgcccttaaagaagaacgaggattagtgccttttgatttcatccattcttatcatattgatgaaaattacattaacgccttagcaaactccataaaagtgcggttaaaatccgatgaatttttactattttcttatcacggtattcctctgcgttatgaaaaaatgggcgattattatcgtgaacattgtaaacaaacgactattgcagttgttaataagctgggcttaacagaaaaccaatggggaatgacgtttcaatcgcgctttgggcgtgaagaatggctacagccttacaccgataaatttttagaatcagctgcaacacagaacattcaaaaaattgccgttatttgcccgggtttctccgtagattgtttagaaaccattgaagaaattgataaagaaaatcgagaaaatttcttaaccaatggcgggcaatcttatcaatatattcccgcactaaatgtagagcatacacatattgaaatgatgggaaaattgatcctagaaaaacttgcttaataatagaaatggtaaaacgtttctaaaatcttccgcactttgctaaaatcagccattattttttcacaaggataaaacatggctgattttccttttatcgttgagatcaacgaacaaaatcttactgaaatactgcaacaatccttagaaaaaccacttgtcatcaatttttacgcgccaacccataaagaatcggcggattttttggtgctacttgagcaagttgcagaacaatatcaaggacaatttattcttggaaaagtagattgtgaaaagagcaaatgattgccgcacaattccgcatccaagcattgccaaccacctattttgttaaagaagcacaggcattagagggcattccaggcatgcttgataaagcatcattaattccacgatttaagctttattttacctaaagaggaaagatttaaatttnccancaagcattagatttcttgcaagtaganaattacgaagccgcattgccattgttgaaagacgcnatgggaactntnccgataagaaaaaccagtgatgttgccctgctctatgcggaaacctatattgcaatgaagaaaacggagccagcacaagaaattttaaatcaaattccattgcaagatcgagatagccgttggcacggattacaagcacaaattgagctacaaattcaagcagccgatacacctgaaatccaacaattacaggctgattatgctaaaaacccaacagctgaaattgcaataaaacttgccgtacaacttcatcaagctggacgaaatgaagaagcattaacactacttttcggcattttaaaaacagatttaagcgcgcagaatggcgaagttaaacaacaatttttatctattttaagcgcaatgggcaatgctgatccgctgacaaataaatttcgtcgattgctttattcgctgctttattaagcaaaaagtttataatcagtaaaatgcaacttattgcattatattattacttaactacaaacaaggattctttatgtcagatatcaaacacgcaaaacttttaattttaggctcaggccctgctggttatacagcagccatttatgcggcacgtgcaaacttaaaacccgtactggtgactggtttacaacaaggtgggcagctgactaccacagatgaaattgagaactggccgggtgattttgagatgactactggttcaggtttaatgcaacgtatgttgcaacatgcagaaaaatttgaaacagaaatcgtcttcgatcatatcaatcgcgtagatttatcttctcgcccattcaaactttttggcgatgtgcaaaatttcacttgtgatgcattaattatcgcaacgggtgcctctgcacgctatattggcttaccttcagaagaaaactacaaaggtcgtggggtttctgcttgtgcaacctgtgatggtttcttttatcgtaataagcctgttggtgtcattggtggaggaaatacagcggtggaagaagccctttacttagccaatattgcaagtacagtgcatttaatccaccgtcgcgatagcttccgtgcggaaaaaatccttatcgaccgtttgtacaaaaaagtggaagaaggaaaaatcgttcttcatactgaccgcactttagatgaagtgttgggtgacaacatgggcgtaaccggattacgtttagccaacacaaaaactggggagaaagaagaactcaaattagatggcttattcgtagcgattggtcactcgccaaatacgaaaattttccaagggcaactagaattaaataatggctatatcgttgtaaaatctggtcttgaaggaaatgcaaccgccacttctgtggaaggcgtgttcgcagcaggcgatgtcatggatcacaattatcgccaagccatcacctccgcgggaactggttgtatggcagccttggatgcagaacgctatttagatgctcaagaagcatanatcttctaaccaattcccctcttttaactcttttaaagaggggaactttttctattatcacgaccannaacatgaatanacttcgccaaaatatttacaaaaatggcttcgcgcacaancagaacctatcaaaaattaatgcgtgcaaacattgncttagctacgctttcttcttcattttagncgcacaacttattttcttgcgacgtgctcgataactgatatgcaaatggcctcgtgatgactattccttat

SEQ ID NO: 514 - DNA, 6785 bp, H. influenzae
  misc_feature (5336)..(5336): n = a, c, g, or t
  misc_feature (5379)..(5379): n = a, c, g, or t
  misc_feature (5452)..(5452): n = a, c, g, or t
agttaaacctgccacgggccagtttgaatatctacgcctaattgtgagtgtaatgcgtggttacggaaagtcgaaactgttttggcattttcaatcccttcagctccacaaaaacgagcttgagcaaagggcaagtctgctgaaatacaaagcacaacagtattacttaattttaccgcttgttggttaaatttacgtactgaagtcgcacacacacctgtgtcgatgcttggaaaaatatttaggactttgcgtttacctgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattatttccaccaattaaagctatccagaatttgattttcgggaaaatttcagccaccacacaataaccaatagcaaagactaatgaaaacagtatgtgcgttaccccaatccagttaaatccgtgaaatcaatagggctgctcggtggaaaaggatgctccgctccccatttaacgaaagcagagataaaacctgcaaaaaattgcaacgccataacgacgtttagatggttctgaaaataagctcattgttgtatccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaattgattgattttttagcggttgtagagcgagtataagctttgtattacttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaacgcctgattttgggctttctgcttataaagataatgctgcagtaatggaaggttcgaaagtcgccgttggtttcctgatcctgatggacaatatcgtgttcatcaagaagatgcgcacattttaatgaaagtgaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgtgcgttacttttaaaacggaatttacgtatttgtaaaatgaataggtaggggtataattatctaccataactaaacaaatcacatcgtttacgatttgtctttttataaataaatattttatgaaggcggaattatgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtntactaaacataaaagaattactgctacacaaaaataagcaganatttatcgttccatttaaataactatggagagattatgtttattacacctatcttcattattaatctagaaanatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattgataaattgatatagtagacaaagcagttgttaatgtttatttttaaatattagcaactgttttattttggaattccacgcaataatcctacaggctcaaaaggttctatagaagttggcgcgggcacttcgctgaataataaaataaatggcttgtgcggaataactttttcatttcgccataaatttcccattccgactaattgaatatcttcgggtaaattacgaagtcctgcttgtaaaactgcaatcgtattttggcgaggatgacctattgcaatggcgggagccgtgttttctagcatagtgaattgctgctttaaattgacgttgaacgtctgcgaattcgttactatcatctaaaaatatatggcgatctaatgaacgcacggccttggtctttttgctattttcccagctacagattttcctattggtcgacatctaaaaaaataaaatgttttcttgaagtgcggcattaaaaagtattaattgtgggatctggcgtagctgactcccataatgattggtcataccgatggcatcagcacaatatttttaggcgatataaccgacattttaattgggctgcagaatttctaaagcggccaacggctttatattactgg

SEQ ID NO: 515 - DNA, 5430 bp, H. influenzae
gagaccccatttttgcgcaatttgctatcaataaatccccaaatcaagccgacaatcaagcctgaaaatgtgcagcatttcccatttcaacaccaaataaggggctaataaaacctaatgcgatccccaccaataacattgtgaaaaaaccttctggcagatcaaataaatgatgattcaatttatcacgtataaatacataacctagaaccgcatatacaacaccagaaagcccaaagaaagcggggccagacacataattttgcacatatcctgttattacagatgctacaacatacaacatcaataatttgactgaaccaaaagtgcgctcaatcattccaccaaaaataaaaaaccaagacagattaaacaaaatatgcaaattagataaatgtaccaatgtatgtgaaatataacgccacgcttcgctatcttgctcttcgtaagcggggtagtgcatcaaatacataatatcgtcttcaaaacccagctgttgagcaatataaataagcgcacaaagtgcggtgagaattagcgtgatttttccttgttgagctaaaaagtttttcattcgtgatctcgtgtttctacggaaatttaaaaatctgacttcgcattaaaagtcattgtttcccctgtaatggggtgggtaatcgtcaattcttctgcgtgcaagcataatcttggcgacatagctttagcctgaggatgtgaataaaatttatcgcctaaaattggatgccctaaagccaacatatgtaatcgtaattgatgagatctgcctgtcacgggcgtcagtttcacgcgagtactgttattgggcaaacgtgctaaaacttcgaattttgtgaccgctcttttccctaaaacgaaatccaaacgttggcgaggacgattttcccaatcacaaatcattggcaaatttacctcgccataatctttctccaaatgcccccaaacaatcgcttgataatgttttttcggttcacgttcgcgaaattgacgttttaattcacgatcagcagccttacttaaagcaaacacaataataccgctcgttgccatatccaaacgatgagctggctcgcaaaagccgaatttttctttcactcggctcattgcactatcgtaatattgtggttgattacccggcacagaaagcaaaccactaggtttattcactacgcacaaatgattatcttgataaataatatctaaataaggttcaaggggcggattgtattcaatcaatgccatttttattccttgttcgtcacaatgacacgcaaacaatctaaacgccaatttgctttagaaagctcatccagtgattgtgttcgttgttgttccaaaatatcaatttcgctttggcgaatattttgatttaccgctcgcaaagcctgcaaacgattaatttctgcgcttaattgttgatctgcctgatttttagcttcggtaataatcggttcagctaaagattttacgagttgatcgcctcgtgtaatcaaggcttcaatattaccccgcgccatttttaccatttgattagcaatatttttaccaagtggttttaatttgctatgcaatgtttcaaaggcaacctgctcaccaatgttatttcctttgttatcaagcagcagacgaataggcgttggcggcaagaaacgattgagctgtaacccttttggcgattgactttccactatataaatcaattcaattaataaggttccagcgggcagttgtttatttacaagcaatgccattgcggctttgccaatatctcccgaagcaacaagatcaataccttgacgaatcataggatgatcccaagtcaaaaattccatttcttcgcgagcaagggcaagttctcgatcaaaggtaaccgtcacaccttcttcttttaaaccagggaaatctggcacaagcattgtccctgttgggctaattacaatactatttgcgccaagatcttcttgctctacgccaataatatcaaataattttaaggcaaaattcacaagctcaggcgaattatcttcatcagcaatttgatccgctaacgcttgtgcttgctttccaccattagaatttagttctaacaagcgatctcgccctttttctaactcaatcttgagtttttctcgcacagttttagtttgttttaataattcagaaaattcattctctgaaagtgcggtagaatttgaccgcactttttccaactcgtcctcaaactgcgaaaataatgccattcccattgggcaggtttgttcaaaagcattcagcccctcattgtaccaacgcgctaaacgaatttgaggcgaatctttcgcacaaggcacataaatttgcacatcacgtttttgtccaatacgatctaatctcccaatacattgttccaataaatcaggatttgtcggtaaatcaaataacactaaatttgctgcgaattggaaatttcgcccttccgagccaatactcgagctcagtaaaacctgtgcgccgttttctaaatccgcaaaataagcggcggctctatcccgttcgataatcgacattttttcgtggaacactgcggcacgaatcgcctcacgttcacgcaaaatttgttctaactgaatcgctgttgccgctgtctggcaaatcacaaaaattttttcatcgcgatgtagtttgaggaaattaatcagccaatcaattttatcattctcttccgagagtgtaatttggtggtaaacacggtgggggaaacctttcacgccttgacgtgtattgcggaataacattcgccccgtgccgtgacgatcaattaaggcttgaatcaattcctgacgggcacgatgctgttcttcatcattatttgatgcaatcgctttaaaaagtggctcaacatcttgttcaagcaacaaatcagaaatatgatttttttctaccgcacttaatgccttatttgccagcaaagattcaatagcattaaccacaggttggtagcgtttctgctctttcacaaaagtttgataatcaaagaaacgttctggatccagtaaacgcaaacgagcaaaatgactttcttgcccaagttgctctggagttgcagtgagtaacaagacagagggaatgatgcgagcaagctgttcaactaataaataagctgcacttggcgcgctttccgaccataccagatgatgtgcctcatccacaattaaacagtcaaattgagcatcaagtgcctgttctactcggtttggatgcgtttctaaccaatttagagaacaaataattaagctttcagtcatgaatggattaacagcatcaagatcaaaatcattgcaacgttcttcatcaaaaagtgaaaaatgcaaattaaaacgacgaagcatttccaccagccattgatgttgcaacgtttctggcacaataataagaacacgttgcactttctcagcaaaaagttgattctgcaaaatcattcctgcttcaatggttttccctaaaccaacctcatcagccaataacacgcgaggattaactcgattaccgacttcagctgcaatatgaagctgatgaggaattaaacccgcacgcgttccgcgtaaaccacgcaatggcgatttaaattgtgcttgctgatgacaaagcgtgcgataacgcaatgcaaaatgactgctgcgatcaatttgcgctgaaaacaaacgatctttcgcttggctaaaagaaataatcggcgaaatatcacgttcttgcacaatgacatcttcatcttgtggggttttaactaaataaaacaacaaaccgttcatattttgaacgtctaaaatctcgccttgccagccagcttgatgggataatgtttcgcctttgctaaacacaattcgacttaaaggtgcttgtgcagcagcatatatcctcgtttcatctgctgcggggaaataaatcgtgacggttcgttgatctaatgcggtaataacacctaatcctaaagcgttttcactttcactcaaccaacgctgaccaatagcaaagggcataataattctctttctgatttacattgataaaattttggggcgtattgtagctcgcatactcttgaaaagaaactcacaaaaaattgaccgcacttttatgaagatatacgtcacccccaatataatttattcttggattttcaacatactcaagcgtaaactagaatctcgactaaatccaccgtgtagggaaaagagatgaattatcgtgatgaattaattttacaatgggtaaatcaacaaggaaaagccagcgtaatagaacttgcacagcattgtgatatttcggtggaaaccattcgtcgcgatttgaacaaattagcgaacaaaggcttattgcaccgaacacacggaggagcagtgagtaataaaaccaaagatttaggttcatttttccaaactcgaaaacatattaatgcaacagctaaacgacatattgcccaaaaagccttggatttgctatatgaaaatgccgttataggtttagatgcaagctcaacaagttggtattttgcttatttaatgcccgatattccttgtacagtagtaaccaactcaatgtttaacattaatgccctagttaataaatccaatgttaaaactattgtcactggcggagtttattcagcaaaatatgaagcattttacggtcccttatctgagtatttattacaacgattacatattaatttttccgtgttttcttgttcaggaattgatcaaaacggtaatatctgggaatcaaatgagctgaatgcctctttgaaacgaaaaatgatagaggcttcagaacgtgcttatttgttaattgattcttctaagtttgaaaagaaaagtttgattcaacttaccgatttaagcaaaattaatacgattttttctgatcaaccacttccagataacttacaaaaatattgtgagctacacgatataatgaccgttttataaaaaaatatgaccattttgaccgaaaattattaaaaatttaaaatatcggtcatatatatttccttaaatatggtcaatttttgtgatctgcttctcagttttgcaacaaaatttcatttcttactattttcctcatcatttttctttcacactctaattcaatgaaagcacaatttgttccgcagtatttcatcattcttactaagcacaaacaaaggagtggtactatgggctcttgctactcaattaaatcgcataaaaatcggtattcgtcccactattgatggtcgtcaatggggaatccagaatctcttgaacccaaacatgcgtatggctcaatctgtgctcattattacaaaccatattcgcatcagatgtactttcgtgaatgggtagtgcagatgcctatcgggggggaactgagcaccgcctgccggataaattaacc

SEQ ID NO: 516 - DNA, 5562 bp, H. influenzae
ccccgctgcagtttgttggcgtaactctgcttccggcgtttttgttccttacgattttgaaccgaattttcattatcgcccactttttccgaaactttattttcagatgtgctattttgttcattcagccatttttgatagtcttctaaatcgcctttaaattcttccacttttttatcgtgaactaaataaaattcttccacggtattgcgtaataaatgacgatcgtgcgacaccaccaccaaagaaccttcgtaatctaccaatgcttccgttaatgcttgacgcatatccaaatccaaatggttagtcggttcatcaagtagtaataaattcgggcgttgccaaacaatcaaagccaacaccaaacgagctttttctcctccagaaaaagatttcactgcttgatttactttatcgccgtgaaacgcaaaactgcctaaataatctcgaacttgttgctccgtttgttctggtgcgagtttttgcatatgccacagagcagattcgtctgcgcgtaaagtatctaattgatgctgagcaaaatagccaagctgcacgccttttgccaactgcactgtgcctgaaagtgcggtcagttctcccgctaaaagtttaatcaaggttgattttcctgcaccatttttcccgagtaaaccaatgcgcgaacctggcactaaattcagtttaattttacttaaaatttctaccgcactttctccgctgccataacctgcacttgcctgttcaatcatcactaagggattcggcaaggattgcggtggacgaaatttaaaagtaaaaggattatccacataagctggtgcaatcagctccattctttctagtgctttcatacggctttgtgcctgtttggctttagtggctttggctttaaagcgatcaatatatttttgtaaatgggaaatcttttgttgttgctgacgatacatcgctgtttgttgtgccaatttagtggctcgttgcacttcaaaggaagaataatcgcccgtgtattcgttgagcttctgattttcgatatggaggatttttgtcacaatcggatcgagaaaatcacgatcgtgagaaattaataccaaggtgccttgatattgtactagccaacgctctaaccaaataaccgcatccaaatccaaatggttggttggctcatccagtaataataaatctgatggacaaagcagagcttgtgccaaattcaaacggatccgccaaccgcccgaaaaggctttcactggctgggttgtttcttcttgactaaatcctaaaccattcaataacgaagcggcacgagattgaattgtccacgcatccaaggtttctaattgcccgtgaatacgtgcaatggcgttaccgtcattgcattcatttgcttgttcaagctcttgttgcaaacggcaatattcacgatccccttgaattacataatcaattgcagaaatatccaatgcaggcgtttcttgattcacccaagatacccgccaatttgctggataatttacctcgccgccctctggcgttaattctttttttaataaggcaaaaagcgaagattttccacaaccatttttccccaccaagccgactttttgcttaggattaatggtagcagaagcattttcgagaagctccgtttgccctcgttttaaggacagattactaaatacaatcatttttctacaataggtcttaatttgaggctattttgcaatattttttcttttctcggaacagtctattccgattttatcgattttctagtcaaaaaagccaggtataataaggtgcaataaaaactatttattgagaaaacttaatgaaaatataacaagtcaatatgaaaataatgggtatatcttaggcattttttacccttagaggcacaatcgacagggttttccctaaaggagcgagcaattttaacaacgtttcaagttgaggattcgtttgtcctttttcaatgcgtgcaatcataggttgcttcacaccgcttaaggtttcaagttgtttttgggaaatcccaagttgctggcgagaagtaatcaattctttaattaaggctacacgtaaattactttcgcggatttcttcttcattgaaaatttgctgttcaaactcattccaatttgaacctaatgggctgattttattcatttttcaatctctcttttaattcacttaagcgttgttgggttgtttggattacataatctcgaattttattcagtttaattcgactatctttgctttcattttgagccagcgatagcagatattctttcactggctcaatgtcattttggtctctgtaaaagagaatctcgtacataatttatcctatttacttatttatttcaataactaataagttattgatttttgatgtgtaagcataaatagaaactaaaaatttggcgagatagtcatttcaatctttcgatcgagatcgcaaaaatagcaaaaagaggttgattttcaaggagattttgcacaaatgccgatgtttgaacattagctttgaaagagagagtaaaaggtagatcctttcttaagaaaaagtgcggtaaaaatttaccgcacttttgattttagacaggtttaaaactcaaattgaactgacatcttataatttctacctggtgcgtagaagcggttaatgccttgacctgtcttttgatctataacattacttgtaccaaatgaacgaattgaacgcgcagaatcccaagtgatgtatttacggtttgtaagattatatacgccggctcttatggttaaatttttaattggttgcacatatccaattaaatctagaatagtataagatttactgcgccattttatgctagtgttggtttggtttttatctttcgcataaatatcataagtatcttctggatttttacttgctacgtgggtagtgtagaaattaaatccaaatttttggcttgggtggtcatagcctaagccatacaccatcgttttaggctgaattgcattcataggaatattgccatccattcttcctttttgataggtatatttatagcttaggttaaatccatccataaattttgccattttaccaaggaatacttttgaattaatttctattccttttactaccgcactatctctattaatattttgataaagagaaaatggtaatgtgctacctccgctaactaatttaaaatctttttctcctttaaatattaggtcgataaagtttttatagttggttttaaatagacttgtggagataaaaccccaatcatcattatgtaatgtaaaagcaatttcttttgtttttgctatctctggttttagattagtatttggcaaaatagtgaaatcagggtgtttaaaggtgaaatacatttcatctgaagttggtgctctaaaaccttttgaatattttagttgtaaacgaagaaaactcgttggatcaatcgttgaaacaaaactgtaagaatgtgctttatattttttgttttgtttagcgatatagtcaatattttgttgtacgtttttcttaacttcaggatcatcattattatttttaccacttggtaatggaataaacaatcctttcacaatatcatcaggtaatttcggtgtaacgccgtgtttatattttggttgataatggatattgtcataacgataacccaaatcaaaagataaataatcagttataacaacattatcaaagagatagactgatttttcttttgttttaatgggtaataagaatgaaaatttaggatcaactcgagggcaaaggttagctttccaccccccataagcggttttacaagtgtgaggtttatcatacaacaaactgtaaccaagtgtaggctctgcccaccattgcacatcagaagcatcattaccagcacgattaaccattcgcttcatcgttgtattatatgagctaccatattgtagattatgttcaacacgccaagttttgaagtctttggttaaatctaaatttaattgttgggtgttggtgtctaaatctcgctcttgccagaggcgttctaaataacctggagatgagggaagaatagagtatgttttattattcgcatcctttactctagcgaaatttttgtcatttaattcttttatttcaagttcaaagtcttttttccacgttccagtagtgccatagccataaagatgttcagtttcaaaaaattttcattttttggttttatctttacaatcaaaatattgaaacaatcataccaagttccagaggatctcctttaggcctagtttaacctctattactcgatcatcagtatcaataaatttatcgaagtcctagatgctggtatcaatattttaacttttttttcaaatgaagttctgaacatctccgcggggttatttcccatctgttatttttagtcccgcaggatttgcagttccctcacaatatcttacacctgcatcacaatagtcatctgtacgtgcgcgagttttaatacgttgatctgaataagtgatttttaatgtatcccaaaatggcgtttgagagaaattttcatagctaaaggaaatattacgtctctttgttttatcattggtgtgtctagaatcaacctcgagtaaattaggatctgttttttgatattttagtgtataggataaatcttgcccacgagaacgatgttcatataaatctgctgcaagggtaaaacgatgattttctgtagggttaaaagataattttaataatgtactatcttgttcaattttgtatgggtctgctttttctctttttttaccttgagtaaggctatttgcatttttgtaatcatagttttcaagttcgtgtccatttctgcttgttgtaaccactaaggcatcaaactttttataacgtcctgcaagagtaagggtattgaatgattgattattttctgtagcgtatccctttttgtagcttacatagtaatccttgttaaggagataatctctcgcatcttttgttttataaattacagatccacctaaggaaccactaccacttttgattgaatttgccccttttgtaatatttacttcttttaaagtttcaatttctgcaccattacgcgtattattgaagttaccataaccctcaaaaagctctttaaagccttgagaagatagggtttcagcttgacgtaatccatcaatattaatcgctacacggttttcatctacaccacgaatggcaaaaccgctttgcccaaaacgcccagcttcaacaacagtaacgcccgtctcgtatttaacgatgcctttaatattggtttgtttgttccttttccatcgttttaacctcgttttaccgtttctttatattctccgtcggctcttttctattctcgtcttcttgccgcaccgctacgtcgatttcctcttatctttctataattcttatttctcttgtcttttcttgtctctcatctatactacttctcatactctttttgctttcttcacctcctctttccaccctttgccttaaagcacccttta

SEQ ID NO: 517 - DNA, 3625 bp, H. influenzae
  misc_feature (3586)..(3586): n = a, c, g, or t
  misc_feature (3589)..(3589): n = a, c, g, or t
  misc_feature (3597)..(3597): n = a, c, g, or t
ctgtatacgatatcgactcggtacccaacgttgccaacaactcgattaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaaaacgaagaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataataaaagtgcggttaaaaatcttattaaattttaaccgcacttttttgtttattctacttctggtaaatttaccgcacctttatagcctaattgtcgccacgcttcataaaccgttactgcgacagaattggacaagttcatactgcggctattggctgtcattggaatgcggattttttgttccatcggcatttcatttaaaattgacatcggaatgccacgagtttctgggccaaacattaaataatccccaagttcaaatttcacttggctatgggctggactgccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctaggggttcaattaagtgcaagcgaaatcctgtattggcacaaaggcgaataatgttccccgtattttgtgggatttctggttcatataaaacaatatctaacataatttttctctaattctgatataaacgatagctcaccattcccgtcgttttttctttcaataacgtccagttttcaggagtaataagcggtttatctttctctgtttctacgtaaattaacgcattgggttttagccagttattttcacaaagcaaactaattgcttgttctgccaaattaaaatgaaagggtggatctaaaaacaccacatcaaagtgcggttgattttgtggctgttttagaaaatccaaactactttgattaattacttcagcctgttctgatgagcatttgagtgtttgtaaattcttttttaattgattggcaacggttttatccaattctaaaaaagtcacctttttcgcttggcgagaaagtgcttcaaaacctaacgacccactccccgcaaagccatctaaacattcagattgatagatataaggcattaaccaattaaaaagcgtttctttcactctatcgccagttgggcgtaagccttcagaatttaatacaggaagttttcgccctcgccatagtccagcaataatgcgaacttcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacggagttagccggtgcttcttctgtatttaacgtcaatttgatgtgctattaacacatcaacctccctcaatggggatnccntagaagtngaacctgcagggcatgcaagtcataggc

SEQ ID NO: 518 - DNA, 6796 bp, H. influenzae
  misc_feature (4732)..(4732): n = a, c, g, or t
agagacccctcacgtataaaaacacacaaaatttaccgcacttttgactcaaaaaaccaagtgcggtttatatttttattaaaggaatattatgtcatctattaaatatcgtccagaaattgatggactacgcgcaattgctgttatttcagtcattatttatcatcttaatgaaaactggttatcaggcggttttcttggggtggatattttctttgttatttctggttttctgattacgggtattattatcacagaaattcaacagaattctttttcgcttaaacaattttatactcgacgtattaaacgaatttatcctgcttttattacagtgatggcattagtgtctttcattgcgtctgttatttttatttataatgatttcaataaattaagaaaaaccattgaattagctattgcattcctatctaatttctatctaggattaacacaaggttattttgatttaagtgcaaatgaaaaccctgtattacatatttggtcattagccgtagaagaacaatactatcttatttttccactaatcctcattttagcttataaaaagtttagagaaattaaagtattatttattataacgctaattttattttttattttacttgccacctcttttattccagctaatttttacaaagaagtattgcatcagcctaatatttattatctctccaacctaagatttcctgaattacttgtaggatctttgttggcaatttatcataatctttcagcaagcaagcaagcaagcaagcaagcaagcaatgttattgcaatattaagtacattactattattttcctgcttatttttaatgaataatgatattgcatatattccaggtattactttaattctcccttgtatttttacagcattaattattcataccacatcacaaaataacattattaaattatgtttatccaataaagtgatagtatttattggaaaaatctcttattccctttatttataccattggatttttattgcgtttgcttattatataacgggcgaaaaacaaattaataatcaatctatcgctatagtaataatattaacaataattttttcagttctaagttattatttaatcgaacaaccaattagaaaatcgaaactaaactttaaacaaagttttctttatatttattttattccttctcttttactcttaggatttaatctttataaaagacaaacaatacgagctgaaaaagaacacattgaacaatcaattcctgtttctaatgaaaatcattatcctgctaaggtcattattttaggcgattctcattcttcacatttagaagcttttctaaactatgcgggaaataaagaaggctggaaagcagatattttcaaagataaatttgaatgtagctttattgtgaatgaacaatatcaattagatcctaattgccaatctgtatggcagaaagattctcaatataaagcgatatttatttcagcattttatgacttgagaatgggcggacagccagtacctcgctttagacccgaaactttcatagagccagattttaaagcacgttttaaaaacacagtgaaacaactagcgatgcaaaagcccgtatatgtttttgctaataatagctcagtaagccgttctccactgcgtggttacttattagaaaattatggacttgaaaaatatttaacgccaattcatcgtatgggcgatattgatgcgagtaacaaaattattcatgatttagtcaaagatattcctaatgtttattgggtagatgctcaacagtatttaccaaaagatagtgttatggcagaaggaaaatacttgtatggggatcaagatcacttaacaaattttggtgcttactatatggcaaaagaatttagtaaatatcaacgagtgatgacacctgaacaagtgaaaaaactctacgagtaaaaactaaaagcgttgagctatttgctcaacgcttttttatatttatttaagtatatccactaacttttcagcaataggtttacgccatccaatcagcagctcggggagtttgtcttgagaacaatcatatttccaaacccatttaattaattcatccaaagtgcgtttactcgcaaggatttcaggggttaaacctgctggtgttaagctattcactttttcttgtaacaatcgaattgtttttttataacgaggatcttcagaaatacgttcaataggttttgggtaatcattaggcgaaacgcgtcttgcttgagcaagcaattgtaaaatctttttaccacgcacgcgtacttcattttcagttaatcccatttctaacatttcagatgtattacgtggattattttttgccactttccaaagattatcggatttcacaatataagaaagtgctaaatcacgctctattgcgacgttttgtcgccactgagccaaaattcttaaacgagacaattcaaatggatttaatttccaagcatttggaatatctaaataagctttttctgaatctcgctcttgtaatttatgtgttttagcaagagccagttcgcaatcatctcttactgcttgttcccaaggtgttttcgctaactctttttcaagaatatgataaagcggtaacaaataccaaacatcgcctgcggcatattgaagttgaatatcagaaagggggcgtttgatccaattggtgcgagttgcgcctttatcgatttctatatttaaatattgttgtgctaattttgccaatcctgctgatgtgccaagcccaagaaagcgcgccataatttgtgtatcaatcattgggcgtggaagctgatcaaattcttgtaagaaaaccaataaatcttcactacaagaatgtaagatttttaataccttagggttggataacaatgcgacaaaaggagaaaaatccgtaatcgctaaaggatcaattaaagagacgcgctcgtcatcataaagctggattaatcccaacttaggaaaataagtggaaacacgcataaattctgtatctagggcaaccgcacttttcatctgagccaaattacaaatttccaatagtgcagcattatctgaaatgactctaaagtgcggtggattttgacattcttttatcatagtgattttttatttaaaaagaacaaaaatgggatattgctatcccattttgacattaatgttttggacgttttgcgatctcttcatcgcgtaaaacccgacgtaaaatcttgccaacattggtttttggcagttcgtctcggaactcaatttcttttggcactttatagcctgtgagatattgacgacaatggttgcgaagttcatcacgagttaaactatcgtcctttttcaccacaaagatttttatcgtttcgccagaaactgcgtgaggaataccaattgccacagcctcagacactttgtaattcagcataacgacatcttcaatttcatttggatagacattaaagccagaaaccaaaattatatcttttttacgatccacaatgcgtaagctatatgattcatccataatgacaatatcgccagttgccatccaaccgtcttttaacacttcactcgttgcttcaggtcgttgccaataacctcgcattacttgatcgcctttcacccataattcgccagcttcgccaatttttgcatcagagccatcatctttaatgatttttatatccgtatttggcactggcacaccaatagtgccattatgtttcacaacattaattggacaagcggcgattaatggcgaacactccgtcattccataaccttcaatgatgttacagcccgtcaattcgtgccaacgtgttgccactgattgttgaatagccataccgccacccacagaaagtttcaacgcagaaaaatcaacttctttgaaattttcattatttaacaaggcattaaataaggtatttacaccagtgattgcttcaaaacggtattttttcaactctttcacaaatccttcaatatctctcggattagtaattaaaatcgccgtgatacctaactctaaaaataataagcagtttaccgttaaggcaaatacgtgataaagaggcaaggctaaaatagctgaacgagtgcgagaatgatcgccaataaatggctctgcaatccatttagcttggaagacattggttataatatttccgtgtgtcagcattgcacctttcgccacgccagttgtaccgccagtatattgtaaaaaggctaaatcctcacgcgatatttctggacgaacatattggcgatatttaccaatactcaatacttcacggaatgttactgcgtgcggtaatttatatttcggcacgagttttttcacatattttacgacgaaattgactaaagtacgtttaccaaaagaaagttgatcgcccattcgggtaagaataacgtgtttaacattggtattgaaaacgactttttccaaggtagaagcaaaatttgataccacgacaatcgctaccgcaccactatcttgcaactggagctctaattctctcggagtataaagaggattgacatttactgcaattaagccagcccgtaaaataccaaaaagtgcgataggatattgcaataaatttggcatcatcaatgccacgcgatctccacgttgaagtttaaattcattttgcaaatatgcggcaaatgcacgactgcgctcttctaatntacggaaagtaagtacttgccccatattaatgtaagcggggcgatctggatgttcgcgcactgctttgtcgaacatatccaaaatagattcatattttgaggtatctagaaatttttcagaaccttctggataattttgaaaccaaattttttccattttttatcctaatttgttggaaaatctttaagattttatcattaattcaaataatagcgaatttcaggctgaacataccaagggcgatatctccatctaaaaaatccccaatcatcatcttcatcccaatcatctgttggatactcatagatggtactgagtgtccaaatacggtatttatccgcttgaacaacaggataagtataatcagcttgttctattttgcctttctctgttccagctaattgaccacctacagtaatataacgttcttttaaattttcaggctcaacaaaaccgttgaaatacacgataaagcgaccatcggattgcaattcaacaaatggtttacctgaaattgatgatacgggtaaacttaacacttcaatttttgtttgatttgctaaaacggtagtattgataatttttcctccaagtcgaactgttttacaatgacaggtcaaatcctgaggagaaatctcgcgataggaattaattgagaatcgctctttttctaacccttttggtggtgcaatacagcccgttaatcccaagcaaagtgcggtaaaaaataaggtgatttttcctttcattttctatcctccagttatttaaacttattcacgccctggtaattttttccaagtaacctcgtttcgcaaataaatcggttcaatttctaaagctggaattgtgtgtttttgcaaaaattctactcgcgcaagttctaacatatataaggcattaggtaatgctatatctgagccagttagattttttttagtaaattgagaataagcagcccaacctgtcccgactctaaatgcgttatcattttgaagctggttaatcgcttgttctggagaacaaacttgttctctaatgatttctcgccattgaaaaacttctccaaaatctgaccgcactttttctctcactacttgagaaaaatagacttcattcattctcgcatcaattgcggcaacaacattttctgcttgatgtaattcaaatgctgcctgagccattgcggttaaatttgaaattggaatgacaggcaaatccgcaccaaacgctaaaccttgtgcaatcccagcaccaacacgaacaccagtaaaactaccaggcccacgcccaaaagctaaagcattaacttgatttaaacctaaacccgaatttaccaaaatttcatcgatcataggtaaaattcgtttagtgtgtgtacgttgggcaagttcattaatatgtgttttctcaccacgatacaataaagcgacagaacaggcttcagtagaggtgtccaacgccaataaagttaaattttgcattcttattctcgtttacttattttgtaagaattgtatcactttgttgagatcacgggtacgacttgagttaggtaaacttttcaaaaaagtttcgccataattgcgcatcactaatcgattatcacaaataatcacaacgccacgatctgtaacatcacgaattaaacgtccaacgccttgtttcaaggtaattaccgcttcaggaatttgaatatcattgaatggatcgccaccttgtaaacgacaatcctcaatgcgagctttcaacaaaggttcatctggtgcggtaaagggaagtttatcaataatcactaaagaaagtgcatctccgcgtacatctacaccttcccaaaagctagaagttgccaccaaaacgctatgcgtttcttttataaattgttcgagtaatttgccttttgaggtttcgccttgtaataaaatcgaaagatgacttttttcacggaaatattcagctaaaccacgcatcattgaataagaagtgcaaagaacaaagcaacgcccttgtgcttcatccgggtatgaggggatctatagagcgaccggaggcagcaagaaggc

SEQ ID NO: 519 - DNA, 6477 bp, H. influenzae
agaaaaaggaacgacagagggggaaaggaacggagaaaaagaaagaaaagggagacgtctggaggaaagaagaaaagaggcgagataaaacaagagacaagatatagaacaggcgcgcaaggagggagagacaaaaggaaaacgccgagaagatagcccaagaagggcaagaggaaaattgtttaagcgggttaacattggcaaaaaagcggaagaggggtgccgacttcacagctaccagcgggaaaatcacttttaaatccccctcccgttaccgttggaaagcctgccgcatttaaccccgctttcaattgcatgagcccacaaataaaccgcaataccaccccaaccccctaatcatgcttttcatcagataaacagtctgacggttaattatcagccacgcttaacaccttatttaccatatcttcaggcatttgttggcctaatgggtaaaagagattaagtaacgagtatgcgctcatttattactcctgctttttacttttgccgtcttttttcgcatcttccgctttcggcgttacgtcaattaatacgccacgttcaattaaacgatcaagccctaccgcatcatcggcaatttccacctcttgattaggggcgataaactcgccgccaacacgaattaaacgcgcttcaatattacgtacaatcatcgctaaatctccgctttggttgccgataacggataacgtaagaacacgccgcccacacgagccacacagttcacaacaagctctaaattgcgttcttgtgccggtaactgggtaaaatcttgcggagtttcaagagttaagttatcaagggatttttcatagcaaatcgctaagtttttattccctgtacccgctttctctaattcccataagccctgaatagttaagttaggatgtttacgcttgaagaacgtcaatacgtccactttgtcagccgtgttcatatacttactggataacgtctgataatctgttagcgacaacaataagtgtgttggctgatgcacgccttttgattgcaacacgacggtatcgtgtagattgtccaaatccgctagcaccgcatccgccgttgcagttttccagccaccagttaccgaggtttctcctaaattcgggtggttaataaagccgtttaaaccaaattctttatctcctaacaaggcaatttcgttcatctttacttccaccgcacgacgcgctgcacgagctttagaagacggtaaatccgtttgattagctgacgccgctttcaactcttgtagattgtagccataagcagcaccgatgtttttcacttttactgcacgttctgtcatcgccacatccgcacgcggtaaatcatcggcatagttggcaacgactttagccatgccgaccatatcgtaaatgcgttcagtcacggtttctgcccattcaggggattcagaagagactgggacgagcgataagccattcatacccggtaatttttcttcatagattttgttgcgcacaaactctaattggcgttgcgtaaacaagcccgcatcttggttaaatacacccaccgcatttaaacaagtcttaatcgcattcaactcaaatgcatcttgacgaatatctgtcattatttttctccaataaaaaagccccaagttttcacttagggcatcgttaaacattgaataattaagctaactcgactaatgcgagcttgccatatttaccgcaatccactacggcggttttaaaggttgcattcggtaatgccgtaccagtttttgccaccttgcctgaagcggggtcaaaacttaccgcacttcctgccgtaatcgcttcactgtctttcactacacaccacgcaacccctttacgcaatacggaaaccgcatcaaatttcgcataaccgcctactacagcatgggaatgtaacgcaatgccaatgggcttagtgccacctaatttagcttgtgtggcactcgtcccttgcgtaatcactacgccgaatgggatttcattttctgctgcaaaggtttcgactaaatcgtaacggctgtcgcctttcataccagcaaaggctttttgttgtaattgatcgtacatagacatcgtttttatgctcctattggttacgacttgcaatcatcgcagctcgaccagttaatttcgtttggctatcctgcgtgaatgtgggttgatttgtggctgatggtgttaattgctgacgctgcacacctgccgcatccgctcgttgtttggcatcgcttaccgcaatatcaaacgctgcttcaatataaccatcggatttttgcgataaatccgcattgtcttgacgaattgccttaattaccgcttcacgcaacgcacggtcggtactatcagctttcacttccaccttatgcgctttcgctacgttttctaattcaacacgcaccttggcttgacttaccgcatcttgtttaatttgttcaacctgtgcttcaagatctttcactttcgcttctgccgcatctgcgcgcgccgcttctttgtctttcgccgtcacagcatctttggcgtcttgtttgagtttatttaattccacaatcacttcgggcgcggcttgatacgtaatgccgctatctaagcgaatgtcagaaagcgttgtttgagtgttactcatcggattttctccatcttcgttaaattccacggcatctgccgcatctaaattaagtgcggcattgcctgcacgcccaactgtcacaatggctaaatggttaggacgaatattacgctggatcacatcatacggctcgccgtcttctgttataccgctcgtctcgtcaatatctaccttatagccaaccgacaattctttttttccaaaatcaacggctttcgtattgtggatcacaatatctgccgttaaattttgcccatcttgtttaccttccgttaagatagagcccaccaccaaatgcgcattatttttcgtcacaagtccgtgatgatcttctgtaatcggcaatcccttgtaagcgcgtaaactatccgccttaaatacttcatcaggcggacgatattcacgccgagttttgccattaggaagctcataaacaaacaccccacttcttgtcagaataggggtgtcataaataaaaccgttatcatctcgccgtgcctgaatgccacggcggtcgtatcgcattaccatttttcttactccgcataaatcacaccgtttagatcttcaaattcagggaataccgcctccgcatagcaacgacataaaataggctcccccggatgtccgtcatcaggtggattatcccaatcaaattgtttaccctcacgatcaacgtggggcgcccgctcacgctcatcaagcataccgcgccaaatatacgacttcacgccgatattttgctggcgcaacttcgtcaaatgaccgtttaacttgccaatttggtcacgagcaattaatgttgcacgtttctcgttggtgttaaggatagacttcacatcatctaccacgctttcccaacgccaaccaccgcgcaccgcttgagtaaagcgactacgcaatttttctaacgtctgcgtaggaaggctttttattaggcggatattttcccattccgcaatttttaacgcatcatcaagccaaggttcagtcgtgaaaacatcgacgctataaactgatttcagcactttatgaaactgcttgccgttaaaattcgccgtctgatgaatatagccacgcacaaactgcgtaatttctttttcatcaacaaaaatcaatactgcttgcaataattcaataagccaacgttcaagcgtatcagaaaaactatcttgtcgaatatttgcctgaaagtgcggtcgaatttcaacgagtttttgattaaccatcgtattaatgtttctcgccacaccacgtaaataacccacatattcacgctcaattgcgtgaggaaacaaccacacctttggctttctgttcttcttgatacttttcaacatcatcgtcatctacctgtggcaatttgtccgcttgaatgccaaactctccagcaatctgtactcgcaattcttctgtggataacgcacccgaatcaaccaaattaattaagcgatcaagctcgattttcgctgcatccgcattcgttttacgcacatcggctatttctttgtcagttggtgtattaagcgacgggaatttgattttccagttctcaaacggcttaatatgcttttgaaacatcaatagctcaatcagcttttcaagcactggcttgattttatgttgctgaatactttcgaccaaatcgtaatagctttcaaaatcgctctgtcctgtggcgttcatacctttagctgactgcccgaataaaatcgccactggaatattcacatcagccgaaatcgctactttaaattcatcaagcacatcaacaatcccgcctaaatccgcattgagaatgttgtaatcgtcttcgctatcaacagctacgccatttaacagactacgcccacgttcaacaagattgatacgctctcgaataacaggctctaatccattatcaattgccaacgcaagccctttcattttatgaaccgcttgctgtttgcgttcaagaattaacgaagcccacatcaatgatttttgataatcacgaatttttggataaaccgatctaaccgcactacgcccaatccaatgtaagccattttttagacgttctggcaatgaatcgccgcccataaataacaaacggctttcatggatttctacctgactatcaagcgaaccagcaatcgtaccgatatttaaccgataactggaatagcgaccataatttggcttggttggatcggaatagcgattagccgtaggcgaaatttgacttaaatcaaacactcgcacttcatcgatacgtgtaatgcgacttggctctaacggctcacttaatcgcgcaccgtcatcggtcaataaaaccataaccgcaccaccaaaaaaccgcgaccaacgcaccatatctgccaatgcaggcaaaatcttcaaccgttcaatctcattgctaatcgcatcatcttgatcgccttgaatttcaatcgaacgtgaaatcgccgcatctgctggcatatcgaccacccgtgcggctaaaccacctaactcatataacgttaaatcaaaaagtgcggttgaatttgcagaatttcttgcaaaatgattaatccccaaggcttcggcgtagccgtcttgattaaatgccatattaacttcctaacccaatgaaacgcgacaatacatcttctttcggtgcgaaacacattaccaacgcatccgccttattcggtgacggaatgccacgctttttcatatctttcttactttctacttttacacgcccattaccgtcataatccacataagggcgagccaattctgcttttaaatattccaaatcccttatatcggaagaaagactaatcatctcatcaacgggatattgctcttcatacgttatcgcccgataggttttatagaaacgatcgcgtaaacgccaccacgcctgagccttaatattggcgaacatatcgcgattggttttaccataaacatattctgcatcaggttcaaataccgcgcccccagcattaaagccattaatacgaatggatttatcgtctaggcgatgatagtgtgcttttacaccggcacccacgccgatgctatcgtaaacaatttcatttgcgccaaattccaatgcattaagccgagttctgtctgcactaccaatcacatcttccccgcgccattcatcaacacgcaacaccacggatccgtgaacaaacgcattggcgttactatccacgccgtcatctgcaacatcaaagcccacaatcttgcgaccggcaggcaaaaagcccaatttcttatgcgcatcaactgcacattcaatccataccggcttaatgataaccttgtcactatcagcaactggctcacctagccaaatatgccgatacagttcatagtcacgctctttgcattcttccatttcaaggcgtaacgtttcagggaaataagggttttcatcgtagttgattttgcgaacgaacgaatttttaggcggcgcaataacaaaccgctgataggtcggatcaagaatatttttcgggttaaatgtcacccaaatttcagatcgctctttacgaatagtcggaattaaaatatcccaactctcattagagacgttttcggcttcttcaatccataccaaatcaatcccctcaagcgatttaattttgttcggattgttctttatgccataaaacataaactccgagccggttttcaagcagtaaatcgcattgcgctgtacttcaaactcttctagatagccaagatcttctatcgtatccgcaataagtttaatcacactatcgctcatcgagttctgcaattctcgcccgcaaaacacccgcactt

SEQ ID NO: 520 - DNA, 8439 bp, H. influenzae
  misc_feature (8309)..(8309): n = a, c, g, or t
  misc_feature (8427)..(8427): n = a, c, g, or t
gccagacttggctggcctgccaggtcgactcttatagaatcccccgccataactaaagaacgatatttttcttgcactgcatgcttatacgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttctttgttgcgataatcgcattgcaaacttcttgagaaacttctacgtattctgcatgcatcacatgatcttcaatattttccacacgaacaggctggaatgttcctgcgcctacatgtaatgtaacaaattcaaaattcacaccctttgctttgagtttttcaagtaaatttttatcaaaatgcaaaccagccgttggtgctgctaccgcacctggtactttactataaaccgtttgataacattctttatcggcttcttcatctggacgatcgatataaggcggtaatggcatatgcccaatggtttgcaacacatctaaaagagcggttgatttatcacttaattccacttcaaacaacgagctatgacgagctttcattactgctttaatgccattattttcgcctaatttatcttcccctaaaaataattcagccccttctttaggggatttcgatgaacgaatatgcgctaagaaacgatgttcatctaacattctctcaactaaaacttcaatttttccaccactggctttacgcccaaacattcttgcaggaataacgtgcgtattattaaaaatcaataaatcgccttgatcaattaaatctaatacatcagaaaaagtgcggtgaaaaatttctccgttttcaccatttaactgtaataaacgacaagaaacacgatcagttttaggataacgagcaattaattcatcgggtaaatcaaagttaaagtctgaaacacgcataataaaatttaggttaaataaaataggcggtaagtctagtttgaattgaaaatgatctcaagaaaaaaactttcctcggggaagataaaataaccagcaattatgctggttatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcggcaactggttcttggttttcaaattgatacacagcagtcaccgtttgtttattgcaggaatatacaactgttttatcagttattgttggaagtgtttgcatttcagctatttgcgcagatgattttgtcatttcaggtgcatcctttgcacaagcagataatacgactacagcagcaaatgtgggtaaaattttagttaaattcattattaaatcctcttaattaatccctatatagggtgctacttagatacctttaataaaataaagttccattattggaataaaaaaggtgggatttgatctgccccaccttgtttatcaataaacgataaaattatgttgatttttaccaacgataccccaatttcacgcccacattttgctgtttgccgagttgtgaaccttgagattttgagataaaagcggaaagttggaaatgtaaaatttctgcctttaatcccacttctttttgccaataacgcccaaatgattgttgcaacatcgtgctatttacagtggtttgtacgttagcgtttgaaacatcaacataattaacgaagaaataaggcttaacgctgatattatctgtcggggtaaacgtataatcaactcgaatgccagcattatagcgattaaatgcaaggctcggtgtttgcactttcacgtcttcagattgataattttcacgttcaataaaatatcgattaacacccaaataaggctgaatacccaattgccctaaacggaactgataacttgcattcacaccataatttatcgcttttcgatgaatttttcggctttgttcttcagccattttactcgcactaattcccgcgcccacgtttacaccaaattgtaaatcgccccattgatattgggcgaaacccgacatcatcgttaatgtcgcgtgatttttaacctgttcgtcaaaggtattatctgaacggctatgcgagaaaaccgccccaattcgtccattatctaaggctttttgcaccccaatttgacgcaagttcgttttctgctgataagcacggaacgcatcagaatcatagcgtcttttatcctgtgcgatatttgtccacacagcagattgtgcttgatctacaaaaagacgatccaattcatcttgaacggaaagcatactatttactgttgcagacaactccgataacgcactatttgagtaacggctgatcaagtctttttgtttgccttgtttctcttgagcttgacgttcttttcccacttgcggttgggcattaataacctcaagtgcggcttttaatacgtctaactggctttgatcaggcgggggatcagaaaacaccgctctcaatgctctttttgaccgcgctttttttgtttttgccttacttttttgtgttttagcattcggttcagcttgtttggcttctaatgcgtttaacaggctttgagcaggcagggtatcaggcaacaccgctcttcttaaccgcacttttgccttacttgtttgtgtttcagcagtcggttcaacttgtttggcttctaatgtttgttctgcttgctctgctcttactaaatcattgtgcaattcctgctcttttattggattatgcaagcggaattcgccattattcttcactaatacataacgtaatgcacccgcatcaacgtggtcattttctaacgtgaatgtgagtttgtctgataacggttgattatctttgctttcaaccaaagttaattgctcaagggtttcgggttctttgcctgtgttgcgaacagataatatgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgtcgtttccgtctctaatgaacggcgacgacggcgtggcgtattgtttggactagctgaataagctgaatttaacgtaacagtactgttatttagtgttaaattctgcaatgtggtatcgctaggcattgtccaagtcgcattttccaacgtcactgttgtgcctttgtcgccctgaatttggtgcgaaagatggctgttttttaaataaaattgagcagaattcgttaaatgcacattaccgttcaagtttgcattatccaccgttgcagttgaattgtcggaaagtcggatattgcctatttgggtagcattgttgcttaatgtaaattggctgtgatttgttaaagtgacattgccattaagttttgctaaacctttaacattcgccgttgcattatcagttaaattaatagagccattgatttgtgttgttggtatagaattaataacttttgtgtcggttaaattctctgttttacaagtcgttaagcctgtccaatctgaacgcgtgcaaatggtattttgttgatttggcacaacaccaaatgtggcgttggcgttattgctgattgtccaatttccctcaattgaagaaacattgcgagaaaccaccgcacttccgcctttaatttggaagttttcagctttaaatgtgcggttgatccaatcgtcatcaataaccacttcgccttgaggtcgcccaagctcgtttgggcgatttaaatgattgtaagcgtgtggcgttgggcgaccactaaacactaaagtgccgccttcttgagtaatatcgccttttaagtttgtgccacctgaaagtagtaaagtacgatcttctgtggttggtttataaataaggtttaatcgtccattgtgtttattttcatctgtttcgccaaaccaaccgttgtaggcaatttctttgctgtaattaagtttattaatattatttccattaggtagaacaatgctttcgttcccagtaatagtgacattagcgacttcagttgtattatggttcacaatcatcgccccctcgtccgtattttggatacgtttaaaggttaatgaatgcccattaagatctaagcgaccaccacgaaagccgaaataaaatttatcggtatcaaattgtttatcatcgtttaattggacagtccctctgccgctaaccaatccgatttcactaaaggcttgttttttatgttgatcgtcctcttgttgttctaagattactttaccatcgccaacgctaattgagcctaagtttttaccttttgcttgaatatgtaacgttcctttaccaattttagaaaggcgatcattttctacgccattgactttccaaattacggtgctttcatcactgatagatatccccgcccctttccacgtttcattatgggtaggcgaaactataaaatctccctcaaaatacaaaccgcctgcaccttgatcgatattattactaaaagttagcaccccttttccgtaatcaataaaataaaggttttcgccgtgacttaatgcgggagaataattgtttacaccaccattagtatagacaggctccgtgcctttcatagataaattgtaattagcaagtttgactttataaattttaccagctccagatgtaatagtgcctgacccatcattttttgaatgaaatgtgtagtgctgattttgttgatttttaggagttctgaaatcaaatatggtcgttttaagattagcagagaaaatttcatcaaaataatttttacggactagctgaaaagtattctctctacctaaggatgggtttccagtacgcaatacaccatttataagccattttttctcggtagcatcataaataaacataggtgacccactgtctccaaatgatcctgctgtcggcataggtccataatcatttcctttacgtacatcgccacttaaactaacatctccatttcctgcaccagtttgcatatgggtattccccgcaataagatatccataagcttcagctacttgagttcctttatcttgttcatttctccaatattgatcaccagaaccaatccgcacacgcatcgggtatttttctttgtctgcataggtctgtcccttcatacttcctgtcatatcaaaaggagaactttcagttacaaatttatgtaaacgaggcatatggtaatccccattataatgatgcttctgatcaggtttataattattacgtttaactatttgataagtaaaacgatgttgatcgggattttgtccttccgcaccaaaatcagcattagtgtatcccccattgtgagcaacacttacaatatattgatcgcctactaatgcagcataaccactacgagcaacagatgcaaaatcaatcatcggagcttttgtcattgatttgccgaccaactccccttttttgttgtaaacctcaatatctttcgcaccgactgcaaacttccctttattctcagcaaaatcacgataatattggtagtcaatcccaaaataagtgtgacctgcccacgcttgcgatactatccctaatgaaatgcaagcggttaaaaaattcagacgaaatacagtttttttcataatgtttatttaattaagtaatttttcgtattaaaaaatacgtggttaaacgactattgaacaataaaagtgcggtgattttctaagggatttcagctaaaaaaacgaactaaaggcacaaaagaaaataaagcagtaaaactatatagtaattaagccaaaatttctaggtttttgcttaatacttagtgggtaatcttatcttgcgatggattaatattatatgtaatttatacagataactaaaattaaaacaatatcactaataaaataaccgcactttatgtgagttttctctgaaagtgcggttattttttctaaggtttttctaaaatcggtttaaggaagcgagcggtgtgggaactttctactttggcaacttgctctggtgtacccgtcgcaataatttgtccgccgccactgcctccctttgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctagaatatacaaagttttacccgtatcacgtttagaaagttccgttgctagtttcacgcgttgtgcttcgccgcctgaaagtgttgtggaagattgacctaatcgaatataggataatcccacatccatcaaggtttgtaattttcttgcaatcattggaatcgcatcaaaaaactcgcgagcttcttccaccgtcatatctaaaacttgatgaatcgttttgcctttgtaacgaatttctaaggtttcgcgattatagcgtttgcctttacattggtcgcaaggaacataaacatcgggtaaaaaatgcatttcaactttgagtacaccgtcgccctgacaggcttcacagcgtccacctcgtacgttaaaactaaaacgtcctggattataaccacgagcacgtgcctctggcacccctgcaaaaagttcacgaatcggagtaaataaacctgtataagtggctggatttgaacgtggcgtacgtccaattgggctttggttaatatcaataactttatcgaaatgctctaatccctcgatagattgataaggtgcgtaatccgtcttttccgctctatttaacgcattttgcgcaagtggaaataaggtgtcattaataagtgtggattttcccgaaccagatacaccagttacgcaagtaaacaaaccaacgggaatatctaaattcacatttcttaagttattacctgatgcacctttaagtttgagccattttttcttatcaagtgcggtgcgttttttcgggatttcgattttatctgcgcccgataaaaattttcccgtgatggaatttggattgagcataatttcatcggcatttccttgtgcaataacttgtccgccatgcacgccagcaccaggcccaatatcaataatatggtcagctgcacgaatcgcgtcttcatcgtgctccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaaattttttccgcaatttgtgctttttgaccagtgagagaaagtgcggtaaaaaattcaagggtttcgccaatgcttttttccgcaattatcggcaaattggtttttccaatatacacattacgtgcttcgggtcgcaaacgagatccgccacagtctatacaaggtcgattactaatatttttcgctaattcttcacgcaccgacattgattccgtttctttatatcggcgagccatattattcaaaataccttcaaaaggatgcttgcgaataaccacatcgccacgatcattcatatattggaattcaatttcctctttgcctgagccatgcataatgatatgttgaatcttctttggcaaagattcatagggcgcttcaacatcaaaatgataatgtttcgccaatgaggtgagcatttgataataatagaaattacgacgatcccaccttttaccgcaccaccagcaagagaatagtcggattttgcacacacgaatctcatcaaaatatgctgcacacccagccatcacaagtgggcaagcactgcaggatngtaaaggaaataaacgagctctaatctgcacagataacacatgcggacagcaaattgctgaaaataaatcttcgcttcgataacatattgcacaacgcatgcactgagcttaatgcgntcaagatcgctt

SEQ ID NO: 521 - DNA, 5870 bp, H. influenzae
  misc_feature (5437)..(5437): n = a, c, g, or t
  misc_feature (5597)..(5597): n = a, c, g, or t
  misc_feature (5741)..(5741): n = a, c, g, or t
ttttaatccgggcttcaaatttgcgggtgcggggcccggattgaaccggcgccctcggggtatgagcccgacaagctaccaagctgctccaccccgggtctgatgaggcgtactatactcgcttaaaatttaattgcaagaattaaacaaaactttatcaaatgtttgttaataaaatgttcaatgtgagttttattaagcaatttcactaaataacactggttgttttctgtaatttttgatagcgtatgcgaccttatttctgcttactttaggattgaaaatgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaatctttctaaaaacaatgaccgcacataaaagtgcggtcattttctttgctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaagccacctaaagtaagtaacgcaccgccaagagccaacgcaggataatgattaatataaaaaagtaatcctatccaagtagcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatagcctaaaagtcagaaataaaaagtacagtcaatttagaaacaggttctaaattaaccgcacttttattatttcagttttagcttatcaagaattttttgatgaatgccaccaaaactgccgttagacatcactaaaatatgatccgtaggttgagcctctgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttgtgaacacccattttcattgtgttagaacgaggttcaagcactgcaagaatacgaacaccaccaactttatctcgtaaagcggttagcgtagcaagaatagcttctggatgatgagcaaaatcatcataaaccgtaatgccattaacttcacctttcacttctaaacgacgtttagcattcacaaaagatcccaacgctttgcacgcatcttcaatagcaacgccagtatgatgagccgcagcgatcgccattaacgcattatgcatattatgttgtcccactacattccattttacttctgccactttttctccatgatggaagacagcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatctgcatggtcaaaactaatgttatttacgataagtgtacgaggattgtaatggacaaatttcgaacgtttatcaaagaaagctgtatcatattcatcagcttcaataacaaaataagggctatctcctaaacgagctgaaatgccaaaattacccgcaattcctccgattaaaaaacctggttttaagccattttgttctaagatccacgttagcatacctgttgtggttgtttttccatgcgtacctgaaatcgccaatacccaacgatctcgcaataaatgatcatgtaaccattgagggccagatgtatatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgttcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaatatgataaaacaacttctatgaactttcaaaagatnagaccatcataccaaactatatgatctataattaacgccactgaactattatttaaccacttcaataggaataaacaatgaaatttaagcgataaaacaatttcagaagcacaatagctcactatttacaaaggaaataatcagccgttctatgtagcanatcttcctgcattacattttggaaaagtatttcagtcgatattatgggacttcattcattttgctgacggacccaaattggtttagttcagaacaaaataatcctataaaaatgcctgtgtaaaacacgcttttttttattcgnacttttagcaattcgctcaaaccaagtttcaaactggcattagttcattccattttcaaaacatatgcgcacgaataaagaacctggagaatacgttaaatttggccgaattggccatttttttggtgt

SEQ ID NO: 522 - DNA, 4644 bp, H. influenzae
agaaacattatctttatcaggcgtagaagaaattgcgcctaaaattgaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattgtaaataatattcaaaacattaattgacaattaatataaaggattttatcattgctccacttcttgcggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgttgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttggcacaatgtaagccaaatccacctacaccacaaaatagatcccataggttataaataggtaattcagatacccattgttgagctgttgcatataatccctccgccactttaggattagtttgaaagaagccttgtggacgaataaaaagcggaatactattgaaattttctggcaaaaattgttgttctgtcagaaaaatttcttgttctccctccaaaatagcagcgtgcagtggttgcaaattaacgctaaccacttctaagtgcggtagtttttctaataattttggtaattctcgacggattaacggcaatttattttctgtacgtaacacaaaacgcaacattaattttcctgttgcgatactttctgtcagtaaaatatatttaagctcgcctttttgtttagcaatgttataaggtactaaacctgcgcgaccaataaaatctttgaggattgaaaaaattattgagaaacgtgcaggataaagaggacaatcacacaaatcaatcgcactttgtggatcattaggattttttaaaataccaagtattgggcgttccacactaccactaacaagcattttagctttattacgaaagcattgttcattagattgaaaaggagctaaccattgagctttatcgcaattaatagaaatcagttgctgttttaaatgatgttgtttttcagcaagctgctgactataaggtatttcaagccattgacaagaacgacattcattttgttgatagtatcgacaatcaatcattttttgcggcctgaatatctagccaacggctttgaatatctgcgagatttcgatgattcagtttccaacgttgatctaaaaccaagtcattccattcgattacgctacgcttaaataaattttttaagcgagcttgacgagccataaagtgcggttcattttcagtaagttttagattatctaatacttgaatgacaccttcacgttcattgcacagtaacaaaagatcacaacctgcattcagtgcttttttgctacgctctacaaaattccccattactcccgcgcctttcattcctagatcatcggaaaaaattgtaccttggaaatttaatttcttgcgtaaaatttctttcaaccaatattctgaaccacttgcaggctgactatcacattgtccataaatcacgtgagcaggcataatcgcatcgagtttattttgtgaaatcaactgttggaaaggttggagatcgtaaccaaaaatttcgtcttttgcgcgatcatcataaggtgtttctaaatgggaatcggctaatacatgaccatgaccgggaaaatgtttacccgtagatgccatacctgcttgatgcataccatcaataaaattgatggctaaatttaccgcactttttacatcagatgaaaaactgcgatcaccaatcgctcgacattcatgccccaaatccagcactggtgcaaaactcaagtcaatatccaaagcaatcatttctgctgccatttgccaacctgcttctttagcaaaacttacttgttcagttgctgatagtgtttcttgaaaagcctgcattgaaggcaacattgtaaatccatcacgaaaacgttgaactcgtccaccttcttgatccactgtaattaataaaggcttttttactcgttggcgaacagaacgaattaattcttgaatttgttctctgtcttcaaaatttcgagtaaataaaatcaatcctgcaacaagagggtgcgaaagtaactcaacttcctcttgttccaactcttttccttttaaatcaattaacaaggtgctcataaattattttaaataaaggcggtaatttttactttctacagtaggtttaattaaatcgattgatttctcttcttgtggttttagcgaaaattgagcggaatagctttcttgctgattttcccaaatttgggtaactcctaaatgatcataccaatacaaatggtaacttacattcaaaagttgctgacttttattttttataaccgctgatttttgagtcgtttcaacttgaattaaaggcgaaagagacgacgtaatattcaaaatcggctttgttgaataagttaagttttgctctgaaattgaacaagctgcgagcataaagctcgccaaaattagaaaatattttttcattatttcgctaacattttacctaagggtcctccaccaactaaatgcatatgtaaatggatacctcttggcccacctatttattgcaattcacaattagcgataaccatctttcgcatggt

SEQ ID NO: 523 - DNA, 6150 bp, H. influenzae
gaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaatccgttaaaaaatttagcataataaagcacacttccacaccaagtgtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaatgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaaactttaaaacattgccgattaatgcgggagggtaccctcttgaaaccacctttgtgagccttgccccgttggtacaaaattcagggattaaatgggaaaattcccacgttcgccataaactttctgtgtactttggatacccattgaagcagccgtcatattccattacgtgaacgccatatcggtgcgccaattttctggaagccaaccgctgagcaagaacgtcaattaaaacaagattgggaagaattgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctttaacttgattttaatattcgtcaaaaacacggaaaaaaccgaccgcactttttagctcattgccataaaaaattaaagggatccgatttcgttcccaaggtggtacgcttaattcttgccagattttttttatatcttctcttgggcgtttcggatgatgtttcactttgcccgaatagccaaaacgaatagaaataggcaagttcgttttttccagcgtaacagagtaatcctgccagtagaaaatcagattatgttcattttcgtgaacagtgagattgcctaaatcatcgggtaaatttagcatgttttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagttggtttttggcaagccacatacgcaaaagtgcggtctgttttgcgagagaatattggcgaaattggagcagtttaaattggtttttaatttgacaatgttctgtaaaaatttcgctcaataaatcattaattaactgttgttgctcaaaacaatgttgtgcggaacgttgtacggctaaatcaaaatgcgcccagcgttcacgtaattttggcaaaatttcattgcgtaagaaattacgatcgtatcgattatcctcattactttcatctgtaacccagttgagcttttcttgttgcgcataatcttctaactgtgggcgagtaaaacctaacaaagggcgaaaaattggcattccgaataatacactttgttgttgcattgcgcttaagccttgtagcccactgccacgttttagggctaagaaaaatgtttctgtttgatcgtttagatgatgcgctgtaactaacatttcttgtatttgaagatgtttttttatggcttgatagcgtgcttcacgcgcccctgcttcaatgccattggttttatctacttgtactcgctcgataatcaatggaatttgaaattgatcgcacaagttttggcagtgtttagcccaactatctgcattggggcttaagccgtgatgaatgtggattgctcgtaccgataaaggcggtaagtgcggttgtttttgacaaagttttgcaaataaagaaagaagtacagtggaatctaaaccaccactcaaggcgataagaaacccttgagcggtggctttttggagttgtttttcaatgtctgaaagtaaatccattaggcaactttttcagctttatagttactgcttggattaagaatttcaaaacgtgcagcaatggtttgtaactcgtaagaacccagttcaaaggtggttttcattgtgttttctcctttgttgtatatttagatcaaaaaagagcggcaaaaatcaccgctcttttagaaagttagttagcaataaccataagacattaaacgttcatagcgtctatttaataattcttctttgcttagttcatcgagttcagctaaatcttcttttaaacgaagttttaagttttcagctattttcgcataattgcgatgtgcgccacccaaaggttcttgcataatgctgtcgataagatttaattcttttaaacggcttgcagttaatcccattacttctgctgctgttgatgccttttccgcacttttccaaagaatagaagcgcagccttctggagaaataacagaataagttgaatactgtaacatattcactttatcgcccacgccaatagctaatgcaccgcccgaaccaccttcgccgataacggtacaaataacaggaacggtaagctgtgccatttcgcgtaagttacgggcgatagcttccgcttgaccacgttcttctgcgccaatacctggataagcccctggtgtgtcaataaatgtgataattggcaatttaaaacgttcagccatttccattaaacgtaacgctttacgatagccttcaggtgcgggcataccaaaatgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataaggacgatttggatgacgcgccatacgtgaaacttgccaagcatcgaggttagcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaagaattaaactgtggcgcaaatggttttcactggttgggcaagcttataatcgctcttttttgaagagtgataagacaaataaaaacgcagaacaaatcacaacagaaggcccagcagcagtatcataaaaggctgataatattaatccacctataatcgataacatactcataataatcgcccagcccaccatagattctggcgttctcgcaaagcgacgagcggttgccgcaggaatgattaataaggatgtgataattaatgcaccgacaaatttcatactcaaggcaatcgtcaatgcggttaatatcattaaaataaaacgcatttttttgatattaatgccttcaacttgtgcgagttctggcgatacggtggtggaaagtaaggattgccaaaagtaaattaatgttgaaagcacaattattacgccaatcccgatataaattaaatccgtataattaattgcgagtaaatccccaaataaataattcattaaatctacccgtacattccgtaataatcctactgtcacaacgccaagagataaacagctatgggcgataatgccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatcgccgtgcaaggtgtgatgatgattgtgatgatgggtataaaagccgacattttgtgcgatctgatttccccataaacgcataaatgttggatcatttgagagaacatcgggcgtacctgcacaacaaatatgttggttaatacacaatacttctttactatccgccatcacaatatgtaaatcgtgtgataccatcaatacggcacaatttaatttttgttgggtttgatgaattagctgataaagctcagcttgaccagtaatgtctacgccttgagtgggttcgtctagcacaagtaaattcggtttatttaaaattgcacgcgtcaataatacacgttgcatttcgccaccagaaagtttttgcatattgcttttgcgtaaatgtgaaatcgaaagttgctcaagtgcggtggatatttcttgggttttaatgcctttttttagcgaaagaaatcgctcaaccgtaataggcaaactatgatccaaatggattttttgtggtacataaccaatgcgaacatttttactataaatgacttcgccagaagtgggcatttgtagttttaataaggtttttaacaacgtagatttgccaccacctttg

SEQ ID NO: 524 - DNA, 6415 bp, H. influenzae
aagacaaaaaaagaaaaaaccacggggacgccggtcgaaaagagaggatgaaggagagaaccacgcagaacaggggagaccggccggaggatggaagagaagtggggtccaatagttgggggggtagataaagaaggcggaagtcgtaatcccatgaccagttttgggaaggaagcgagagagatacccaccccgtaaaaacatcattgtgttaattctgggattacgaatatatttgcgcggatttggcacgatatgcttaggggataaaagcaataatttcgtggaatgaagttggggtaatatcgctaatgttcttttgtttgcgtcgcaaaccccttcatgggcagcgacaattaacattgcataatgcacaccaccctaaacctgccagcatgtttgacaagaatttttcatgccccggcacatcaataaagccaagtactttgttttctaacggcagataggcataccccaaaatcaatggtcattccgcgttttttttcttctggtaaatgtgcggtacttgtgccagttaatgcttttaataatgctgttttgccgtgatcaacgtgacctgaagtaacaataatcatagttcatccaatgtatttaataatgtttcaatagctgcaaggctacgtaaatctagccaaatttttccgttttccattcgcccaataataggttgggaaagttgtttaaaacgagctgaaagtgcggaaagttttacgtttgttttttctgcaatagtaacagccacggaagggattctttccattggttgtgagccactaccgatttgtgcttggctagcttcaatttgaatatcaaattgtgaatttaagcgagattctaaccgctctttgagacgcatagcatttattttgagttgttttaatggttgcgtgagtaagtacaaagttggtaatttttcagttaatttttcaggatttaaatacaaacgtaatgtggcttctaagccagctaaaatgactttatcgcaacgtaatgcacgcttgagaggatgggcttgtaattgttcgatccattcttttttacccacaataatgcctgcttgcacgccaccaagcaatttatcgccagagaaagagaccaaacccacaccttgtgcgactttttcttgcacagttgattcttttggtaagccatattggcttaaatctatcaatgcgccgctacctaaatcagtgactactggtacattcatttctcggcctagttccgcaagctcttcttctgaaactgaagaggtaaaaccacaaatttgataattgctgctatgcactttcattaaaaaagccgtattttcagtgatagcattacgataatctttcagatgggtacgattagtggtgcccacttccactaaatagcatccagcttgttccataatatctggaatacgaaatgcaccgccgatttcaattaattcgccacgagaaataattacttctttaccttgagcaaaggtcgctaacattaacaataccgcagcagcgttgttattcactatgcaggcagcttcagcacctgtgagtttgcataataattcactgatgtaattatcgcgatgactacgcttacctttatctaaatcatattcaagcgaaacatttttttgcatcacagaaagcgctgcttgttgtgctgcttcagaccaaagtgcccgcccaagatttgtgtgcaataccgtacctgtcagattatgcaccgctttgatttgtacttggttttgtttttgtaggcgagaatgaatttctacaaaagtgcggtcaaaattagaaaaatattcaggaagttgattgtttttttttataaattgacgagcttgggttaataattctcgacatgttgccacgactgcagtgtgaccaaattcggtaataagttgtagaccttgagatgttttgagaattttatcaacggaaggaagttgttgaaaaagtgcggtcatttttgaatccgtttaaaataacgttgaattgccgattaatttacgctaaagtgaccgcaatttcaaccacggaggggcgtcatctccggtgaggtggcaggatttcaaatcctgttgaggacgccagcgttcttgggtgggttcaactcccattcccctccgccaatccatataaacctttgaatttatcgctaggatataatatttaccccaccattttctttaactgatacaaatacgccaaggcttgtttagggcttaaatcatcgggatccagcttttcaatagcctctcttagtgcatccgtttcttgttcaaacaataattcgccctgattgtgattggcttcacgcaacgcttgaatttgctgttcggctgaatagcttgagtttttttctaattgtgtcaatttctgttttgctagtttaatgacggattgtggcacgcctgccaaagccgcaactgccaaaccataacttttacttgctgcgccatcttgtacggcgtgcataaaggcgatgctgttgttatgctcaagggcatctaaatgaatattggcaatgccttctagctgttccggcaatgcggttaattcaaaataatgggtggcaaataatgtaagcgagcggatttttttggctaaccattccgcacaagcccaagctaaggataagccatcataagtggatgtgccacgaccgatttcatcaataagcacgagactttgctcagtggcttggtgaagaatatttgccatttccgtcatttccaccataaaggttgaacgccccgaggctaaatcatcagacgcaccaattcgagtaaaaatacgatcaatcggcccaattcgcgcactgtctgctggcacaaagctaccgatatacgcaagcaatgtaattaatgcggtttgacgcatataagtacttttaccacccatatttggcccagtgataattaacaaatgacggttgtgatttaactccactggattggcaatgaaaggatctttcaatacttgttccacaacaggatggcgaccattttcaattttcacactcacttcatcacagaatgttggcataacgtaattgagggtatctgcgcactcagcaagattgactaacacatccaattcagagagtgcaaggctagccagttgtaatgaacctaagtgcggtaataataaatcaaacaattcatcgtaaagctgcttttctaatgctaacgctgcacctttcgatttcagtactttgtcttcatattctttgagctcaggaataatgtaacgctctgcatttttcaaggtttggcgacgtacataatgaatgggtgctttatgcgcttggccttggctaatttgaatgtaataaccatgcactgcattaaaaccgatttttagcgtatcaatacctgtactttcacgttcacgtttttcgagattttccaaatattgcgttgcaccatcagacagcatacgccattcgtccaactccgcatggtaaccttcagcaattacaccaccattccgaattaaaagcggaggcgtttcaatcaatgcacgttgcaataaatcccattgctcactgaaatcggcaatttggctgaaaagtgcggttaaaaatggcgatgttttttgttgcacaatcgtgcgtaatgcaggaatttgttctaaggctgtgcgtaagcgagtgagatcgcgaggacgcgctgaacgcagagccacacgcgctaaaatacgttccatatcgccgactaattgcaaataaggttggagttcatcgactaaatcaaaattcagaatttccgcaatcgcttgttggcgttgttttaatttttccacatcacgaataggctgatgaatccaacgtttcagcaaacgactgcccattggcgtaacgcatttatccaagacagaggctaacgtattttctgtgccacccgaaagattttgtgttaattcaagatttctgcgcgtggcggcatctaactgaatgcagtcttggttttgaattaagctaatgctttgaatatgaggtaatgcggtacgttgggtttcttttgcatattgcaataaacaacctgccgcacttaagccgagaggggatttttctacaccaaaggcgcgtaaatcttttgtgccaaattgacgatttaataacgtaatggcagtgctaagttcaaattcccaaatcgggcgacggcgtaatcctttacaatgttctatggctgccatttcattaaattcttcacaatacagcaattctacaggcacaatacgttgcaattccgcacgcaatgtttctttatctgcaggttcacaaagctgaaaacgcccagaagtcatatctaaagtggctaatccaaatttttctttttcttgatataccgcagcaatcagattgtcttggcgttcaggcaacagtgcttcatcactgaccgtaccgggcgtaacaattcgcacaatttgacgttctacaggtcctttgcttgtagatggatcaccaatctgttcacaaatcgccacagattcgcctaactgcactaattttgctaaataaccttccaccgcgtgataaggcattcctgccattggaatgggctgtcctgcagattgccctcgtttcgtcaaagaaatatccaacaatgccgccgcttttttcgcatcgtcataaaacaactcgtaaaaatcccccatgcgataaaacaacaaaatatctggattctctgctttgagttttagatattgttgcatcattggcgtgtgctgttggaaattttcttcggaaatcatctaattacctgctttgaaactgaataaagataggttttatggcggctattttaggtgccgaaaggggaaaaagccagataaaaaagtgcggtaaaaatttgttgagattttttaccgcacttaaaattgatattttccccttagaacttaaagaaaggtaagcagccaaacattgcaagaaaatggaaaatagctacaaaaacaccaaataatgcaataaagattattaaaccatttccaccacacactcggaatgttgcagctgtatttattttgcgggatttataggcaagaagagcaggaattatacttgtccaaatcgtagctaccgcaccagcatacccaatagcttttaagaaacccaatggaaataaattgacataattagtggaggtaggaaagtcacagcccatgactttgttcgtccaattttacaattatcaaatttaaagaaatcagccaaataatcaaatacgcctaatcctacgccaataaaagatgataaaattgcggcgatagaaaaggcattaatcatttgtttaaccgtgttagattcgattactccacctaatgtgttaagtaaaatatctaaattaccatcactggcaattactggagcaaattgatctcgcggtaagttgccaaaaatagagaaaatccaaagtaaataaagcgtaagagcaattgctgttccacctaagatagcgtattttgcttttttttcttccccatagtaagctcgcatcgtacaaacagaatgatgatagccaaaagatgttaatgcaacgggaaacattcctaccgcatattttgcataatttgtctcctttccaccaatatctaataaagtgtctaaactaatattagttgctaatccataagtactaaaaataaaagtaaaacccatgcatacaatcaataaaacagatattctgtctacaatgcgagtggagtgccaaacaaagaaggaaaaaactaatacaaatacagtggaacaaattgccaatgtagatgaaccaaaatcaatccacggtttaataaggttttctagtataccgccagatgcagtggtataagcataaagtaaaatacccccgacaaaatataccgcaagattattaatagaattgacagttgaaccgagcatatctttagttacagtactaaatgaagctcttaaatcataagtagagtaggcctcaagtaataaccagcctgacaatgtcatgactatcattgttaagcaaattactaatactgaccatattgtccaagcacccgcgccagatgtcggcaaaccaagcattcctgccccaacacaaacactagcaataatacacgcaccaccaaagatggaaggttgttttttcatataacatccttatcaataacaaaatattgagttagctgttgataaaaaaatgcagttcaaaatgaactgcatttttcgtgatattattcaacttctttataacgtgccgtaaagaggcggaaaacttttggtcataagtaaaggtaaacccctaatattctctgcattttctttcactttttggaaagcctcataaggaaatccatatgccgttgcgtataaatggaccggggatagtataacctaaagctcccgtggaattgggggatttcac

SEQ ID NO: 525 - DNA, 6363 bp, H. influenzae
accccttcatccattcaatcattgggcgtttattcctgttaattttattcttgaaacggtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcattaatcgttttttattaaccagctctagggctaaaacttaacttctattggagaaaattatggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaactaatcaccttatttgcttatcaacgtaaaacaagcatagtaaggaggacgttgtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagttataagaggcttagcttatgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatgggaaaaaagattagctcgcaaagtgaaattaaattgcaacgtggataacgcacttattgctggtgtgattgttcgtactgaagactttgtgattgacggaagtagccgtgggcaacttactcgtctcgcaaacgagttgcaattataagaggaatacaagatgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttggtagtaacggagagataagatggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatttaagaaaagaggaacggtaatgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaagtagaaaacacaaataacccaattcaagtaccagtaggcacaaaaacacttggtcgtattatgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatgtaatcacttcaagtcatttgaaggagaacaaaatggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaagcaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacgataattgaaagtataatatagatgaagtgaacttcatttagtttaagggctaagttctataattttagaacttagcctttttgttgtatgagattaatgataagttttgtctgaaatttttatctaaattaattaggataatatttactcttttttagataaaaagtgcggtaaatttttagtttgtttttaacctacaacaaagggtaaataacccgcacgaatcgcaaatggaatggatgtaatgatcacgcctaataccaatacgataattaaagtcagatttcctccccacactttgtatggcaaattagcgtgggcacgacgagctttccaaacaaggctaactggcaatactacggcgtagaatgcagggtaccgagtccgatattcggaaaca

SEQ ID NO: 526 - DNA, 6821 bp, H. influenzae
  misc_feature (5346)..(5346): n = a, c, g, or t
atctcacttacgtcatattttgactaaaaaaacactaaacgtaaacgtcatttacgtcataaatcaatggttgcgaaagcagaccaagttttagtagtagcttgcttaccatacgcataagccgttatttaagcaaaacgtacgattagttcattttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactttaattttttaaagtttagataaagaagaattaggacgctgaaaagcgtcctttttttgcatttgtgacttcaaattttgtaaaatgatgccattagttctcatctgttaaaatctatggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaatcgtgagcgtataacagatgcgattaataaactcactgcctttgctaaaacccaagataaatccgcatttaaaaatgatgaatttcttaccgcactttgtgataatttagatatttttgaggcaattcatcgcttaaagttagctgaacaaaatatggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttttaatgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcattagatgtgttagttgtcgatgaaacatcaatgattgatttgccgatgatggtaaaacttatcaatgcgttaaagcccgaaacccgattaatttataggcgatcaggcacaattagcctctgtgaggcgggggctgtatgggggaattagctcaatttgttcctcaaccttaatagtatgaccaaagtcgcatacttnttagcaccaccaggctacaaagtagaaggttccgattgttcaaatcccaaatacgtgattgcttatgccatctaacagaaaggtccccgttttataaagattcaggcattggaaaattggctgaattcattcaaaaaggcaaagcagacgatagccttgagttatttgcccattatccgcaagaattgcactttaatgccctaaatgatgaaagcgatgcggtcaatcaagtggtgaaaagtgcggtggaaaattcccgcactttcttaaaaatgtggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagtgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaatttgtgaaggataattttgggattctaataattcttgggctttagcttcttgcaaactacgttcttcgtagcgagtaatattttccccttcgcgatgtttacgaattaggtaaatccatttccaatttgattcttgattttcgagtttttggtatttcattttttatcattgagtgacgtggtaactgcattaatatacgtgtttatatgccgttttctagggttttcgcaggctataaaggaacaggctgaatagaaaca

SEQ ID NO: 527 - DNA, 8957 bp, H. influenzae
  misc_feature (6783)..(6783): n = a, c, g, or t
  misc_feature (8617)..(8617): n = a, c, g, or t
  misc_feature (8901)..(8901): n = a, c, g, or t
  misc_feature (8911)..(8911): n = a, c, g, or t
  misc_feature (8913)..(8913): n = a, c, g, or t
  misc_feature (8943)..(8944): n = a, c, g, or t
acgaaattcggctcggtacccatacgttttcacaaaaaatcctattattttgaacgctagaatttgaagttgtttattctacacgcaaaaacgaatttttctgtcaaaaatgttgatgtaaatcaaaaaaactctcaatagcatttcccttgcctttcaatattcagtaacatagctcccgtcaagtgattgcttgatattcataaagttcctaaataaaataatgataaatatagctaaactactttcctgccacccgtttcgggtggttttttttatctaagtcgaaagatgcactcttgcattgtgcatttattcttattatgatcagctcgagtataactaagagaataatagatgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattctattcgagtgaataaacaatatcgtttaatttttaaatatgaaaataacgaagtaaataatttatatttagatccacattcttataatttgtaaggaggataatatgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatgtaatttgagccctaaagtgtctatttaatttagggaatacttcactctaaatattgacaagtggttaggtttcgccaaacttttgcaaaatctgtccacttgtttcctatattttcgccctattttccagtagaatagggcgaatttttttgtgaggaattattaatgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaattgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagctatcattcaagcgcatgatgggcataatttagataaccaattagagcgtgcggcagatgcgttacgtttacctgattgggatgccaaaattgaacatttatctggtggtgagcgtcgccgagtggcactttgccgcttattactcgaaaaaccagatatgttgttgttagatgaaccaactaaccacttagatgcggaatctgtggcgtggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgtttagaacaagaacaagcaactgaaaacgcacgtcaaaaatccattgcgaaagagttagaatgggttcgtcaaaatccaaaaggtcgccaagcgaaaagcaaagcacgtatggctcgttttgatgaattgaactctggcgaatatcaaaaacgaaacgagacgaacgaactctttattccacctggcccacgcttaggcgataaagtgattgaagtgcaaaacttaaccaagtcttatggcgaccgcactttaattgatgatttatcattcagtattccaaaaggggcaattgttgggattatcggagcgaacggtgcaggtaaatcaaccttattccgtatgttgtcaggtcaagaacaaccagattcaggttctgtgacaatgggcgaaaccgttgtgcttgcttcggtagatcagttccgtgactcaatggatgacaagaaaactgtgtgggaagaagtgtctaatggacaagacattcttactatcggcaactttgaaattccaagccgtgcttatgtggggcgtttcaacttcaaaggtgtagatcaacaaaaacgtgtgggggaattatcgggcggtgaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggttatttcgcacgaccgttggttcttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaagtaatttagattgagaaagtgcggtggattttgaccgcacttttcttacttttttgggagtgattatgttagttgatttacatatttttttcgcctttttaagtttggcattgttagtaattcgtggtgcaatgcagcttaatggtaaaaattggcgttcgataaaattattaaaaattttaccgcacttatcagataccttgctgattgtgtctggcgtcgtcattttatacctctttgcttttggtattgaatggtggttagtggctaaattcgcattactgattttgtatattgtgtttgctgcaaaatttttcagtaaaaaagtttctcaacccaaaagcattttcttttggcttgcttgcgtaagttttattggtgcgatgttaattgcctatttaaaataaaacgatgtcatctcgccagcttcaaattttaatctgcaaaactttgccgcttgtgcctgataacgtattaattatcggcgaaagtggcattgctttttctaaagcaacgaatttgcttggacaagaatttgaacatatcttatttgatgcgcgaaatggcattcatcttgaagcgctggctattgcagctggaacactgaaaatgggcggcacactttgtttagtgttatctgattgggaaaatttatctcagcagcctgatcaagatagtttacgttggaatggaaatcagtcagcaatcgccacgcctaattttattgatcatttcaaacagtgcattgaacgttatcatttccccattttaagagaggaaagtgcggttgaatttcctacggttttttattctaacgaacatcacaaaaatgctacgttagcgcaacaacaaattatcgagactattttacaagccgagcaggatatttattttctaacctccaagcggggaagaggaaaatccgcattattgggtatgcttgctaaccaaattcaagcaccagtttatctcaccgcaccgaataaaagtgcggtgcattccgttattgaattttcagaacgagagatagaatttatcgcgcctgatgaactggctattcggttacaacatgaaccagaattcagtcaatcagcttggttgctggtagatgaagcggcggtaatcccattgccgttattgcaagaatattctcaatattttcaacatattgtcttcagcacaacaattcatagctatgaaggtacggggcgtggtttcgaattaaaatttaaacggaaaattcaccgcacttttcagcattttgagcttaaacagcccctacgttggcaagaaaatgacccgttagaacattttattgatgatcttttgttgctaaatgccgaagatgattttcagcactttgactataacaatattacttataacatagaggaaaacgctaaaaatctttccttcccctgcttgcgaggaaaggtgccccgaagggcggaagggggatttagatatagccagcctccctcaagctttggaagctcccctcacaagtaagggtagtaaaggaaaatataatcgtcaatttttatttcgagatttttatggcttaacgacattggcgcattatcgaacatcgccactcgatcttcgccgtttacttgatggagaaaatcaacgtttttattttgccgaatatcaacagaatttgctcggtgcaatttgggcattagaagaaggaaatatggctgatgatgagttgattattcaaattcaacaaggcaaacgccgcccgaaagggaatcttgttccacaggcgttatgtttctatgaaaacttgcctcaagcctgtaaattacgatctttacgtatttctcgtatagcggttcagccaaattggcagcaaaagggcattgggcaaaatttgatgcaagccatggaaaatgccgatgtggattttctttcagtgagttttggctacaccgacgaactggcaaaattttggcaaaagtgcggttttgttttggtgcatttaggcgagcatcaagaagcgagtagtggttgttattcagcgattgcccttaaaggactttccaaagaaggcttggctttagttgatactgcgtacaaacaatttcagcgtaatctccctttatcttttcatccgtttgccataaattttgagcaaaatcagcttgattggcagcttgatgattttgattggatgagcttaaaaaacttcgctaattttcaccgcactttattttcgagcgttcctgcgatgaggcgtttattaaaattagcgggcaaagaaaatttcccattaatttccgcttatttaacaaaaaaacaacttcctattaacaagaaaaaaggcgtagaatgtttgcgtttagaaattaaacaatatttagagcgaggaactttatgacagaacaaaccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagacaaaagaatcttctttaaagaaataaatattaactgtttttttaaacagtgaacttattgaaagatagagcaaattccagtacactatgcctcaattttacacaagattgacgcattatttatatttatgaaaacggcttttttccaacctgatattccaacccaacccaatgatcacaaaattttaggcaatgtattaccaggcgctgatgcattggcgattagtgaaattgcagagcaaaaccaaaatttaaccgtagtggtgactccagatacacgaagtgcggtgcgtttatcacgtgttttatcggaattaagcagtcaaaatgtatgccttttccctgattgggaaaccttaccttacgatactttttctccccatcaagaaattatttcctctcgtttaagtgcgcttttccatttacaaaatgcgaaaaaaggcattttcttattgccgatttcgacattaatgcaacgcctttgcccgccacaatatttacaacacaatgtgcttctgattaaaaaaggcgatcgtttggtcatcgataaaatgtgcttacaattagaagcagcgggctatcgagctgtggagcaagtattagaactcggcgagtccgcagttcgtggttccttggtggatcttttcccaatgggaagtgcggtgccttttcgccttgatctttttgatgatgaaattgattctattcgcacttttgatgtggatacgcaacgcactcttgatgaaattaactcaatttatcttttgccagctcacgaatttccaacggtcgacaaagggattgaatttttccgtgcgcaatttcgtgaaacttttggggagattcgccgagatcccgaacatatttatcagcaaatcagtaaaggtaccttgatttctggcattgaatattggcagccacttttctttgttgaaatggcaactttatttgattatttgccggagcaaacgctgtttgtagatatggaaaataatcaaacgcaaggcgagcgtttttatcaagatgccaaacagcgttatgaacaacgtaaagtggatccgatgcgtccgcttttatcgcctgaaaaattatggcttaatgtagatgaagtcaatcgccgattgaaatcttatccacgtattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttctgtggagacggaaggtcgccgagagactttgcttgatttgctttcaccgttaaaactcaagccaaaacaaattcaatctttagaacagattgaaaatgaaaaatttagcttgttagtcagctctcttgacaaggttntataattgaacaatcgcttcctgttgcgattattggcgaagctaatttacttggcgagcgcattcaacaacgttctagagacaaacgtaaaacaattaatcctgatacgcttgtacgaaatcttgccgaactgaaaatagggcaaccagttgtgcatcttgatcacggtgtgggacgttatggcggtttggtcaccttagatacaggcggcattaaagccgaatatttgctactaaattatgcaaatgaatcgaaactttatgtgccagtgacttcattacatttgattagccgttatgttggtggctctgatgaaagtgcgccattacataaattagggaacgaggcttgggcgaaatcacgccaaaaagctgcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcgaaagaacaaaaaccaattctggaaaaccttgcagaaggaaaagtcgatatattaatttggtacccataaattaattcaatcagatgtaaaatttaacgatcttggattgttgattattgatgaagaacatcgttttggtgtagggcaaaaagagaaaatcaaacagcttcgtgcgaatatcgatattcttacgctaacggcaacgccaattcctcgaacgcttaatatggcgatgaatggcattcgtgatctttccattatttccacacctcctgctcgccgattaagtattaaaaccttcgtccgtcagaatggcgatcttgttgtacgagaagcgattttgcgtgaaattctccgaggtgggcaggtttattatctccacaatgatgtcgcaagcattgaaaatacagcagaaaaactgaccacgcttgtgccagaggcgcgagtaattgtggggcacggacaaatgagagaacgtgagttagaacgtgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgcccccacctaaaatgatgacaaaagatgctgaacgccgtctagatgcgttggaaaatcttgataatcttggggctggttttatcttggcaacccacgatttagagattcgtggtgctggcgaattacttggaaacgaacaaagtggacaaattgaaagcatcggtttttcgctttatatggaattattggatgcagcggttaaagcgttaaaagaagggcgtgaaccatcattagaagaattgacgcaacaacaagcggatattgaattgcgtgtgcctgctttactgcctgatgattatctaggagacgtgaatatgcgtttatccttttataaacgcattgctgcagcagagagtaaagcagaattagatgaattaaaagntgagttgattgacagatttggattattgcctgatgcaacgaaaaatttattacaaattacagagttgcgtttattggttgagccgttgaacgttgtgcgaattgatgctggaaccaaggcggttttattgaggttttcagcaaagcccaagggaatccagaaaatttattccattaattcaaaaagaacctattggtgtatcgatttgagggcccattaaaatttaagtttattgaagatcttatccgaaacaaagggccggtagaaattgggggggatttgtnaaaaacaacngntgcataaaaaaaacccccgacattgggacnngatttttttctaa

SEQ ID NO: 528 - DNA, 7150 bp, H. influenzae
  misc_feature (583)..(583): n = a, c, g, or t
  misc_feature (712)..(712): n = a, c, g, or t
  misc_feature (6487)..(6487): n = a, c, g, or t
  misc_feature (6549)..(6549): n = a, c, g, or t
  misc_feature (6612)..(6612): n = a, c, g, or t
  misc_feature (6634)..(6634): n = a, c, g, or t
  misc_feature (6721)..(6721): n = a, c, g, or t
  misc_feature (6739)..(6739): n = a, c, g, or t
  misc_feature (6851)..(6851): n = a, c, g, or t
  misc_feature (6856)..(6856): n = a, c, g, or t
  misc_feature (6860)..(6860): n = a, c, g, or t
  misc_feature (6876)..(6876): n = a, c, g, or t
  misc_feature (7020)..(7020): n = a, c, g, or t
  misc_feature (7048)..(7048): n = a, c, g, or t
  misc_feature (7050)..(7050): n = a, c, g, or t
  misc_feature (7100)..(7100): n = a, c, g, or t
  misc_feature (7102)..(7102): n = a, c, g, or t
  misc_feature (7124)..(7124): n = a, c, g, or t
  misc_feature (7144)..(7144): n = a, c, g, or t
  misc_feature (7147)..(7147): n = a, c, g, or t
gaaaatgccaaccgcaagcagaaagaattgctaatgttgcgataagcagtaaagtcttgattgagttgatcataaaaattacctttattgtaggacgtgtaaaatgtaaatatttcacatacctataaaaaatggtgcgtgaattttaaatccacacaccctatgtattatggtttcactaccacgtttaataatttacctacgacataaatcactttgacaatgtgttgattatcaataaattctttcacattttcatatcgcaaaagcaatcgttttgactgtgtcttcatctgcatctgccgcaacagtaactttgccacgaaccttgccatttacttgcacaacaatcagtttttcatcttctaccattgcggcttcatcgacttttacccattctgcagtatcaatagcactttcattgccaagagcttgccataattcaaaacagatatgtggcgtaattggataaagcatacgaacaactgcacttaatgccttcgcccataactgcacgatcttgctcgattatcaagcgatgccttagtcagtttattcatcaattccatcactgcagcatcgncagtattaaatgtttgacggcgacccaatatcatcgctcactttcgcaatggtcttatgaacttcacgacgaagcactttttgttctgcggaaagtgcggtgatatctaggctagtttgtgctggattntgttgatattgatataccaattccaaacacgccctaagaaacgtttcgccccttctacgccagattcttgccattccaaggtcatttctgctggagaggcaaacatcataaagaggcgaacagtatcggcaccatatttttctaccatttcttgtgggtcaataccgttatttttggatttcgacattttggtcatgccactgtggactaattcacgcccttcaggatcggtggctttaataattctgcctttttcatcacgttcaagagtcaccagtgttggacttacccaaatacgctcattggttggacttgtgtagtagaaggcatctgcaagcaccataccttgacataataatttatcggctggttcgtcactggttacaaatcctgcatcacgcaataatttgtggaagaagcggaagtagagtaagtgcattgttgcgtgttcaataccaccgatatattgatccactggtaaccaatagtttgcttcttccgcatcaagcatgccattttgatattgtggacaagtgtagcgcgcgtaataccaagaggattccataaaggtatcaaaggtatccgtttcttttaacgctggtgcgccgttaagggttgtttttgcccagttaggatctgctttaattgggttttttacgccatccattaccacatcttcaggcagaataataggtaaatcttccattggtgcaggtactacatcgccattttcaagggttagcatcggaattggcgcaccccaataacgttggcgagaaacgccccagtcacgtaaacggtaattaacttgacgttttccaacacctaatttttctaatttatccgcgataccgttgaatgcaccatcaaagtctttaccatcaaattcagctgagttcactaatttaccgtgctcaacgaaagcttgtttagttaaatcaatttcttcatctgcaatgggttcaataacttgcttgatttgtaaactgtatttttgagcaaattcaaagtcacgttggtcgtgagcaggaactgccattactgcgccagtaccgtagtgcattaacacgaaattagcgacccaaatcggtaatttttcgcccgtcaatggatgaatagcaaataagcccgttgccattccttttttctccattgtcgcaagatcagcttctgccactttggcgtttttcgcttcttggataaaggcggctaattcggaattgttttgagctgctaaacttgctaatggatgtgccgctgcaatgcctaaataactcacgccgtaaaaggtatctggacgcgtggtgtaaactgctactttttcgttggtatttgcaacatcaaaggtaatttctaccccttcagagcgaccaatccagttacgttgcatggtttttaccatgtcaggccattgtggaagggcatctaaaccacctaataattgctcggcatagtcagtaattttgataaaccattgtgggatttctttttgttccactggtgtatcacaacgccagcaacaaccttcgtgtacttgctcgtttgcgagtactgtttcatcattcggacaccagtttacggttgaggtttttttgtacactaagccttttttgtaaagctcagtgaagaaccattgttcccatttgtagtattctggtttacaggttgcgatttcacgatcccagtcaaaaccaaagcctaaaagttgaagttgtttcttcatgtaggcgatattttcgtaagtccattttgctggtgcggttttatttttaattgctgccccttccgcaggtaagccgaaagcatcccaaccaaatggttgcaatacgtttttgcctagcatgcgttgataacgagaaatgacatcaccaatagtgtagttacgcacgtgccccatatgcaggcgaccagaaggatatgggaacatagaaagacagtaatatttttctttagattcgtctttgattgctttgaaaactttattttctgcccaatattgttgaacctttggttcgatcatatcggggcgatattgttcttgcataaaatcaccttaaattttaaccgcacttttgcagcattttgacaatagaaaatgtggcatagaataccgtaaaatggcaaaaattaatagggagagaaataaaaagtgcggtggttttttagttgttttttacaataaattttcaatttttacagaacagattagaacaaaggaatccatggcaagccaatataacttatgatatagtttaccaccaaatttatagaggtctctcaataataaaaataatgatagagttggatcaaacaaatataccaaaacacgttgccattattatggatggtaatggccgttgggcaaaacagaaaaataaaatgcgaattttcggacacgccaatggcgttactgcggtacgcaaagcagtggcttatgcacgacaaatcggtgtggaagtactcacactttatgcctttagtagcgaaaattggagtcgcccagaacaagaaatcagcgcgttaatgtcgctttttatgcaagccttggatcgcgaagtgaaaaaattacataaaaataatatttgtctgaaaattataggcgatgtatctcgttttagtgaaactttacaagaaaaaatcaaaaaagcggaaaatttaacagaaaaaaataccgcacttacactcaatattgcggcaaattacggcggttgttgggatattattcaagccgctaaacaaattgcagaaaaagttaaaaaagaagaaatgtcagtttcagatattaataactcgacttttcaacatcatcttgcaacccaaaatgcaccacctgtggatttattaattcgcaccagtggagaacagcgcataagcaactttttattatggcaaattgcctatgcggaattatatttttccgatgtgctttggcctgattttaatcaattagaatttaatcacgcgattgcaagttatcaacaacgtcatcgccgttttggcgggactgaatagttaaacggattaaaattatgcttaaacaacgagttttatctgctattgtgttaattgctgcagttttatgtgcgctatttttattcacgcctttttattttgccctcgctttaggggcggtagcgattttaggcatttgggaatggactcaatttgctcgccttaaacaacctttgatacgtttttttgtggctacctttttaggcgtatttatcttcttatggctctatactgagggcaactatttagatgcagggcgtgtgtttgaacaacatcttcagcttttattgataaatgctgttagctggtggggtttagctttgttgcttgtgatcagttatcctaaatcagctaaattttggtctaaaaatccacttttacaacttttatttgccttttctacgttgattccatttgtcgcaggtgtattacgtttacgtttagaacactatacccatgatccttatcacggcttatttttattactttacgtatttatacttgtttgggcggctgattctggtgcttattttagcggacgcgcctttggcaaacgtaaacttgcccctaaagtatcgccaggtaaaagttgggaaggggtcattggtggattaattacagcattagtgctttcttttatctttattcatttctctaacaatactttagtaggcgatcgaaatattactggatttatcattctttctgtagcgacagttgcaatttcagtattgggcgatttaactgaaagtatgtttaaacgtgagtcaggagttaaagacagtagccaattgattcctggtcacggcggtgtgttagatcgcattgatagcttgactgccgcagtaccttttttcagctatttctatttctttgtcttataaggatttttaatgtcatttttgtggtcactaggttcttttatcattgcgattgctgtattagtatccgttcacgaatatggtcactttgggcagcgagaaagtgcggtataaaagtccatcgttttcccattggttttggaaaagtaatttggaaacgcattgacaaatatggtacagaatttgcggtttcaatgattcctttaggcggctatgtaaaaatgcttgatggacgtaatgaagtagttcctgctgagcaaaaatcacaagcatttgacagtaaaagcgtattacaacgcgcatttgtaattattgcaggccctttagctaattttatttttgcaatttttgcttattggatcatctacctttatggaatgccaacggttaaaccagtgattcaatcaataacaccaagttccatcgcagcacaagctcacattgaacctaatacacaaattctagcggttgatggcgaagaaactcaagattgggaaaccatcaatatgctacttgccacaaaaatgggtgagcctaatgttgaaattaccctttctcctttcaattctaatattgaacaacaacggactttaaatcttacaaattggatattcgatcctgaaaaagaaagtgcttttgaggcattagggattatgcctatgcgccctaaaattgaaatggtgctttctaaagttgttcaaaattctcccgctgagaaagctggtttacaaatcggtgataaaattttaaaagaaaatttaaccgcacttccttggcaagattttataaaacaggtcgaacaaggcgaatctttttctattaaagttgaacgtaatggagaaacatttgacaaagtcctaactccagtgcgtaatcaaaatggcaaatggtttgttggggttagcccaaccttgacaaaattagcggatgaataccgtactgaattaaaatatggtattcttgaatctttacaaaaaggcattgaaaaaacagggcagctttcccttttaaccttgaaaatattagggaaattacttactggcgatttgtcattaaataatttaagtgggccaatttctattgcaaaaggtgctggtgcatcagcaaatattggattggtgtattttttaagttttatggcattgattagtgtaaatttagggattatgaatttatttccattaccagtattagatggcggtcatttagtttttttaacaatggaagctgttaaaggaaaacctgtttctgagcgggtgcaaagcatctgttatcgaattggcgcagcactgttattaagcttaacggtgtttgcattatttaatgattttttacgtctataatttatataggatacaatcgatgaaaaaacttctaatcgcaagtttattattcggtacgacaacgactgtgtttgccgcaccttttgtggcaaaagatattcgtgtggatggtgttcaaggtgacttaaaacaacaaatccgagcaagtttacctgttcgtgccggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagaacactatgcaagtgtaggtcgctataacgcaaccgttgaacctattgtcaatacgctaccaaataatcgcgctgaaattttaattcaaatcaatgaagatgataaagcanaattggcatcattaactttcaaggggaacgaatctgttagtagcagtacattacaagaacanatggaattacaacctgattcttggtggaaattatggggaaataaatttgaaggtgcgcaattngagaaagatttggagtcaattngggatttattatttaataatgggctatgccaaagcaccaattactataaccgtgtggttagcttaatgctgaaaaaaacaaaaggtnatgggaaccattggtggnaaccggacggttccggcgtgcccttctagcggccgcataataggtgatctgcgcggctttgcttccgcttctccacctctttcgtgcgcccccgccttattttctgctccgncgccncctncgttttcccgttcgtntcgtcgtttcctgctctgctctccgctggctgtcttcagtcatcctccgccttcttttctcctattcccccttccctcccttctctgttccacctctttttgttgttgcttgcgttcctctccctcgtgctcgccctcccgccncgtctgctctttcattctgctttgtttngncttgcctcttctctctcattgttccttcttcttcccctttcctcgtgacncncgtgtgttccctttcgtcgttncgcgttcttgtcgaacttcncancct

SEQ ID NO: 529 - DNA, 9967 bp, H. influenzae
  misc_feature (4130)..(4130): n = a, c, g, or t
  misc_feature (8251)..(8251): n = a, c, g, or t
tgacattctttctgtagaaaacttatgaatccaacttacaaagcgaaattaaataaataatttacgccaaatatcaagaaaatttaccgcactttaatctgtgccttaaagctgaataaataaaccagctaattgggtgcagatttttttatgattaaaatgttttaaataaccaatatttgttgccattgttaaatgttaatggcttatctaactaaaatagttgaaatttgaatgcatattaatgcggtgctttaagtaaaagtaaaagtaaaaggactaaattctgcggattatagaatttagtccttaaacaaatgtatctgatttttttaagattagatcgatttttctcttttatgtttctctctattcatctaaaaaacttctcagtgtttcagaacggctaggatgacgtaatttacgtaatgcttttgcttcaatttgacgaatacgttcgcgtgttacatcgaattgtttacccacttcttcaagcgtatggtcggtattcatatcaatgccaaaacgcatacgtaatacttttgcttcacgtggcgtcaagccttctagcacttcgtgagttgcaacttttaaactttgtgctgtggcagaatcaagaggaagttctaaggttgaatcttcaataaaatcgcctaaatgtgaatcatcgtcatcgccaataggtgtttccatcgaaatcggctcttttgcaattttcagtactttacggattttatcttctggcattcccatacgttctgccaattcttctggtgttgcttcacgtcccatttcttgtagtaactggcgagaaatacgattaagtttattgattgtttcaatcatatgcacaggaatacggattgtacgcgcttgatccgcaatagagcgagtgattgcttgacgaatccaccaagtagcatatgtagagaatttgtagccacgtcgatattcaaatttatctaccgctttcattaaaccgatattcccttcttgaattaaatctaagaattgtaaacctcgatttgtgtattttttcgcgatggaaattactaaacgcaagttagcttcaaccatttcttttttagctcgacgtgctttttgttcgcctcgtgcgactgcatcgcaaatgtcacgcatttgagtaatggtaagtttagtattttcttctgttatcgctagattgtttaaggcttcataaatacgatcttcatatttaattaaacgtttagcccaaggtttgctagattttaatgcttttgctacccattcactgttactgccattagcggtaatattttttcaaaatcatcctttggcattcctgctatatccactaatttttttgtagctgacgttcttggtagcgcacacgtttcatcatttctttcattgatagaacgagtaaatcaaattgttttggtactaaacggaattgtttaaaaatttcgccaagtagtgcaatttgatcttgggcacgttttccagagcgaccgtgtttttcaataacagcaagggttttagagtgctgttctcttaattgctgaaatttttcgcgagcaacttcaggatcaatactgttatcagagtcgcttgaatctgatgtagattctgattcattgtcttccacatctgcattactagattcttcttcatcatcttcgtcagaaaagtcttcatcaagtccgttgtgttcttctatttcggcatttggatcaacaaaacccgtaattaaatcggtcaaacggaaattacctttttctacatcatcatagttttttagtaatccatttaatgcttcaggataggctgcgatagaggtttgaacttcatcaatccctccttcaatacgttttgcaatgctaatttcatcttcacgagtaagaagatccaccgttcccatttcgcgcatatacatgcgtacgggatccgttgttcgaccgatttcagattctacatttgaaagaatttgagttgcttcttccactgcatcttcatcagggatggtatcactcaacatcatatcatcgctttctggtgcttcatctaatacagggatacctgcatcattttgcaacgtttgtagcaatttgtcgtaatattcaggatcaatagcatcttcgggcaataagtcattgatttcagcaaaagttaaatacccttgtgtacgacctagctccatcaattgctcaatttgttctgaatattgttcagccgtagattgttgatttttttccatttttatactcgttttgcttgatgtgattgagaagataagatttttttatgaacttgagattctaccattgttatagcggattcactaactgttttttctgctgttctttaccagctaaaagatgtacaagtaccgttttttcttcattagtgagaccctctgttcgttctttagcaataagcatttcaatatcgcgctcaatagcttgaatatttaagcgacggtaattttgagaaaatgcgttgattatgtcggattcgtctaataaatgatcccaagttgccagtatttcaaggggattactgtaagatgtattgcggaagtattccaaaatttgccccgtagtaatgccctctcgttggcgacaaagtgcggtcaatttttccagaatttcaaaccctgcttctgcacgtaatgcttgcacgccgctttcagacatacgttttactaactcaggattttgcagaagcaatgaaatgaccattcgcattggtgtcttcttgatcttattatgagtgactttttgttgtgtattggcttgttctaattgtttgggaataagattttccagctgagtttgatcaaaaatcccaagtttttgagcaagcatattgcgtagcgataagcgaagcatttctcctggaatttggtgaattaacggcgcagctagcgcaactaattttccgcgcccttctttagtggaaaaatcaacctgaggacttaaatgtgcaaacataaactcgcttaaagattgcgcactttcgatgtattcttcaaatttttctttgccgtattgacgaatgtaagtatcaggatcttctccatctggcaagaaaataaatttgagttgtctgccatcttctaagtaaggcaacgcattttctagtgctcgccaagcagcatcacgtcctgcacggtcaccatcgtaacaacaaacaacctgttcggtcgaacgaaaaataagttgaatttgttctgatgtcgtggacgtacctaaagaagcgaccgcataatccacgccaaattgtgctaatgccaccacgtccatataaccttcaaccaacaagtaattgtttgggttcatcgttggtttgtaaggcttcatacaaaccataaagctccttacctttatgataagtaatggtttctggcgaattcagatatttcggtttttcatctgttaatacacgcccaccaaaagccactgtgcgaccacgtttatcacgaatcggaaacatgatgcgatttcggaatttatcgtaaatattgccacgatcatttcgagaaagcatgcctaattcaatgagtttttgttgttcttcacgattaacaccaaatttacgcagtacagtatccattgcattcggcacaaacccaatttggaaacgctcaataatttcaggtgaaagcccacgttgttgtaaatattcttgtgcttgagtatttaatggtaattggttttgataaaacgtggcaatctcttgcattaattcatagagatttcgtttggtttggtaattagcttgaggttttccgctgtgattagcgcgtttttcgtaaggtatttcaagccctgccattgctgcaagttcttcaatcgcctctataaattcaagtttgtcataatccattaaaaaggaaatcgcattaccatgtgcaccacaaccaaagcaatgataaaactgtttcttttggctaactgtgaaggatgggagttttttcgtgatggaaagggcagcaggcttgataatcgcggccagctttttttagttttacgcgcgtgttaatcacatcgacaatatcggactttgtcagcaaatcatcaataaaggggcgtggaatagaacctttcattgtcgagcctccgtgatcgaggtgtgaaagtgccggncgttttggcggagatttttattgtgctttagtacataaccgtgagtccaaggattcacggtttgtcttaactcgagtcagaaaaactataaattagtataaacgggtattgcgcgcgttttcgcgagcgttgcgttttgcgtgacgttttgcaagtgttgcattttcacgtttacgaattgtagttggtttttcgtaaaattcgcgagcgcgtacttcagctaagattcccgctttttcgcaagagcgtttgaaacgacgtaaagctacgtcaaatgattcgttttcacgtactttaattacaggcataagccaatcacctcaatgagtttaatttaattgcaatttaaaattttatttttgccaaagcacctgtgtgtaaatgacaaatttaataaaggacgcaattctaatctatttttagggaaaaagtaaaggatagaatgccaattaaccttaatatttgtggtttcaactggttaaaaccgcttaaacagggtaaaatcgcgcaacattttaggtaataaattaagaaaatcaatgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatttaggagaaaaaatggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatttaaattagtttttaaacacaacattataaggacaattttatgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcggggtaatatttgatttttccctagagaaaacacttttcttcctctgtttgcaggggagctgccgaaggttgaggggagatatagaaagcccccttccgtccttcgggcatcttcccccacaagtaagggaagttattttctacaatttatccgaatgatgaatcattacaaagcgttcccaaagctgttcttcggtttcttgatgttcaggatcgggcttaatacagttagtgattgggcaaactttttggcaggttggggtgtcgtaatggccgacacattccgtgcaaagtataggatcgatcacataaatctcatcgccaatggaaatggcttcgtttgggcattcaggcaagcacatatcgcagttggtacatttgctagtgatgaataatgccattgtgatccttaatagaaagttgaaagcggcgaattatagccgacaaaaacttgattgacaaaaactaaacaaaattaatgaaaaaactttccttccattctttctcttatggttctcgttatattagcaatttggcaatatttttacccgatacaaccaaaactaaacatcaatcatcctcgcccgtaattgagcagacgaagcaaacaaaagtatctgagccctaaaatttgaacctaaattcgagcctcaatttgagacaaagcggacggatattgaaaaagtgcggtaaaaaatccagatgtttttgcnactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaatacccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataagaatttctttgatctaaatcgttacaacctagcacgaagtaggtataatacgaaaagttttcaattttaattttaacttaacaagaggatagattatgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggttttagagttctctgaaacggcagcagcaacagaaaagcggtaaatgaagtgaaagatgatgaatctatttttgatattggcgataaatcagcagaacaattggctgaaatatcaaaatgcaaacccgttttgtggatggccaatggtggggtttgggattccctcattcccgaaggaactgaatcatttctacgccttgcaacagggagcatctttttgctggcggggggtaccttacggtttgattattgggattgcggaaaattctacttcacgggggg

SEQ ID NO: 530 - DNA, 8401 bp, H. influenzae
  misc_feature (8179)..(8179): n = a, c, g, or t
  misc_feature (8304)..(8304): n = a, c, g, or t
  misc_feature (8330)..(8330): n = a, c, g, or t
atgctaattagggggctaaaagtatttctgcattgaatgactatactcaacgtattgtgccattaaatgatgcgatgaaaggaatgaataactattacaaagaccgtaaaaaagcctttgtgctaggttatttcggtgatcaccaagtggcatttgataatgctatccctccgaagaaaggggattatgccacagcccgattatgtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccagataattttcttagatcgagcattattgctcgatctgctcgccaatttcatctaaggttgaagctaattgtgcaccaactaataccacaagccaacttatttgaatccacaataacataattggtaaagttgccattgcaccgtaaattaattgataagagggaaaagtgacgacataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatactcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggtgcaaaattagtaaaaatcatttcttttaattctcccgtcacttcattgaatacaggaaaagcagagaaaatagaaaaaataaccataactaaggaactattgctaacattgtgctataagtcaatgcaccagcgacttgattaagtttattttctgaaaaacgttccaaaataataatccaaaattttttaatgaaatcatagaaatcccccacaacaatgtttaaattttttaccataaccacatacacaaggttgtttcattgtcggtaatgatacggtcggatcaacaaaataccaacggttttcaatttttacaaaaattgaccgttcttgatgggctagttctccctcttcgccttgaaaaatcgccttaaattctaccgcactttgagtttttgtaaggctttccgtttttagaatttctaatcctagccacgtagtgttgtccgcccattcttgcaataacctaggctttaataaagtttgttggcttggcgcagttgttacaacaatatagggaatattttttaacacataagccgtataacgtgaacgcataagttgctctgccgtttcgggaaatgcttgtctcaaatgaaatttgccacaacaatctgcgtaatgatgactagattgacatggacaattttctaaagaaagtgcggttgaaatttctgacatatttatccctgttgtttgaatttcgatatttgcgatcgaattgagcgtttaaaggcttcagctaatacttcaatctctaatgctgcatctaattcagcttcattttcgggcgcagataacaagcgatttaaatgacgaattgttatttgcggataaggacgggcgagtaattttagttcatccttttgcttaattgttcctgtttcaataatacgaacataccatccactaagcccagtttgataaacaatatcgcgagtatcttcgttttccgtgttttttgataaacgctcacaaggtttacgtggttgagatacttctaaaatggttgagccgatttgataacgatcgccaatacatacattgtcttcattcaagcctgacacgacaaaattttctccgtatatcgcagtatccatataagaaaaatctttatttaataaagtatttaattcattaaaagaatctgccgacataaaaaagagagctttatctacacccccgtgatgtttttttaaaccaacatcgtttccttccgcaccaagagaatgaatttttaccgatggcacaacttttttacgaatcgcgctttcatactggcttccatcggaaaggttagggtttcaacttgtcccacttttataactaaaatttttgcattcattttatttttcgcttgttctagaaaaaatttacgtggaattataaccgaaaacgtttaactttttgaccgcacttctttttttacttattattcgttatcagaaaaacaaaaaagaaataataaaaatgtttgaaagagaaaaaaattttctaaaaatattttatttcttttcttgaaaataagatttttcctaagggcgaaatcatcacgttcaatgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagttaaattaatatttatttgaaacaataaaactttattttattctgcaccttaattagatttattttctaacgaagtaaggtgcagatttttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacgcccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatctgcataaaaaccggaaatactgataaaaataccaaatacaatggcactaattaataacaagccagtaaatgtatttgctgggattcctaaaccaagcgcataacctgcttcagaaagctttggcacggttcgagaatatgcctgtgcaaaagccgtcataatgtaaaacaaagaataagttgccaccataataaatgtaccaatgatcattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagtaaatagctagctaagaagaacgttccattagcgacaaataaaccaattggtgcgcctaattgaggaaaagtaccgtaccaagctcgttttccttctggtgcattttctgttgcgactaacgctgcacctccccattctccaccaagtccaattccttgacctacgcgacatacacaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgcgcaaaaaatgctaaagcaagcgtagaaagagaaagtaaatcattagaaagcggatcatcgctatgaaagaattgcgtattgaaaactaatacagcggcagccgcatagatataataatcaaaaaattcgattgccgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgagttttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcagcattttgccaatattttccccacaatttgattttcgtttttcaaccaactgtaatctttcttctgcagtcaaatgagaaaacacaggttgttgataccaatcattcaacactttttctggtggttcttgtataaaacgttgcgcccaagcaaaatcctgctgaaaacgagcctgcttttcttcgtcagtttttaaacctagattcgctccttctaaaataacgccttgcaaattagatcgttccacctgagctttcagcgcataatacaaagcgatccttccacctagagaatacccaacaagaaaatagggttcatttttcaccgcacttttaatttgcttagccaaatactcagccgtttcttcaaaatttgtgacttcaatatctctagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatatttaagcaccaatcacggcgtgactaatttgatcgattaagcgtttatacaaactactaccatcactcggattcgttttaatttcaattaacgttgccttgcgacgactataagcctgtttaacaacggaattgagatccgcccaagtataaggatgagcgtatttgagatcgaacattgccgcgatttgagaaaaatcgccattatgcggtaatcgatagaactgatctttgacttgttcatccacaggtaacatatcaaaaatcgcaccaccattattattgatcacaaagattagcgttggttgcgtaacatttttgaataatgcgaaagaatttagatcatataaagtggacgtatcgccaatcaccgcaacaacaggtttatttgaaccaatacctattccagcagcagtagccaacaaaccatcaattccactcgcaccacgattggtataaacgggataactttcgggtaattgcgttagcgcatcaaccagacgaacaagtaaactattacctaaaaataaaacaccgttataaggtaaaagtgttggtaaacgtaatgctagcgaggcttccgttaaatttccgcccacttgctgttcaataaaggtcgcacagaacttagataaagctaacggctcaagcaaccaaggcttttggcgtaaaggtggatgcgcacgtaaccaatgatgcgctttagcattgaatcttgtcaatgaatgatggtaaggatctagtgctttaccgctttgttcaactagccaaaattcccctttaaacgcctgcaagaattgattaatgcgtttactaataaaacgcgcgccaaattgaatcacaatatcagcttgtagaagtttttcacgaacagtttggtttgctagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttggacttctacatttatccaagacttgttttgaattaaccagcgttgtaacggctgtagccaactatgggaatttacttcctcatcagttgcatcataaagtggctcggtaaatggcacattaatatgaacaacgccaccttgttgtttttgttggaaagctgcctgttcaagtagagaaatcaaccactgcgcagaataatcagcgttcggtttaggtaaattaacatttgcaactggatactgaccaaacatattttgttgcaaaatagcttgatttgcaccgcactcccaaagttctggtggacgatcagcagttaaaacaaataaattcacaccggtttggcgcgcttcaataattgctggataaaggtttgcagtcgccgtgcctgatgtcacaataatggcaacaggtgattgagttgccttagcaataccaagtgcaaaaaaacctaaaccgcgttcatcaaaatgcgtatgacaagtgactgaacctgcattttgcaaacgtacggcttctagagttaaaggtgtcgaacgcgaacctggcgcgatacaaacgtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatacacgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcgcgaattttacgaatcaaatgttgtactttacgtaacggtttcaattccacattgcttacatcaaaactttctacttgcttacgtaaattctgcgaaatatcttctacgaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataancaaccttgatttttgttttttcgctttctgctaaaaaatcgtacgcattaatcgcttgctttaatgaaaagtggtttcattggctacacaatttttgtcagctctccacttttaatttccaccanagcctgatttacccaacacaccaagntcttttattagctcgaggctcttatgcaaagaaattggtttggtacgcaaaagggggggagattttaaagg

SEQ ID NO: 531 - DNA, 6732 bp, H. influenzae
atcttcctcttgacatcgctaagtctgtgtaaaacttagatttttgcctgatcaattttacacattaaatatgctaaaatagacattattcaaaactatcaaaaaaccgaccgcactttatgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataactaaaaaaacgccagcttaagctggcgttccatttatttattttcacctgaagaatacaagcgatttttatataaataactacctaataaagcgtgagccaatgcctcttttttcattgcatcaggtacgtcttttggcgttaaagtttctgttgatttatcataatgataaccttgcgctgctttatttgacatttgaattaccacatcattattgcctttcatcattgcttgagtttgatcgtattgcataaaagcacgatctgggtttacatcttgcgttaaatcaaaaccaatcattggataattgccacttacgccagctaaagaaagcaatgtagttggcatatcaatttggctcacaagacggctatcacggcgtggcgtaatgccatcaccaagaatcaaggctggaatatggaaatgcttaatcggcacaagacttgctccgcctacacgagaatcgtgatccgcaacaattaagaaaatcgtatctttccaataattagactgttttgccattttaaagaaatgacctaaggcataatccgcatattttgctgcgttattacgagtggcttttggttgctcataaagctcaatcttgccatctggatattcaaatggatcgtgattgctggaactaaacactaaactaaaaaacggtttaccttcattttgtaatttcgtgaaagtttcattggctttatcaaataaatcctcatcactcacgccccaagtgccagtaaattttggattctgatagtcttgttgatcccaaatatctttaaagccattaccgtagaaaaaactcgccatattgtcgaagtgcttttcgccaccataaataaacgaagtgttatagccttgtttatgtaataaatccgcaatagtaaagaaaccactttgggcattattaagtttcaccactgcacgagctggtgttggcgtaaaacctgccgttgttgcttcaataccacgtactgaacgtgtgcctgttgcataaagattttcaaataaccacccttcttttgcgagctgatccacatttggagaaagtggtttgccaccaagtgttccaataaactgagcaccgagactttcttgtagcaaaatcacgatatttttaggtttaccctgataagtcgcgacatttttcgttaaagttgggtatttatctgaaatgtaatcactttctggacggccacgactggctttaacaatacgaaaaatttcatctgcatccatttttccgtacatttctgaagatttttcttcatctttaaattgctgtgccgcataaatcacggaatagccagaattaagcaccagagaattcactaacgcatcagaagaaaatgccaccatagcgggatttataccacggtgttgaaaacttgaacgtgccccaaggaagctcaagacaatcacaagcaaagcaatcacagggcgaagtttccaactgattgaacctaaatttttgactgcccaaccagaaattttccaataaatcacggcagctaaaatcgtgaaaacaaggctaaaaattaccgcacttaaatgtccttccgcaagcattgaaaaaacttctttcggataaatcaagtattcgataaataaacgatttgggcggtaatcgtaggtttcaataaaggcaggtgtggcaatttccataaagataataaacacactaccaagggttagccaaaggcgtaaaatttttacccaaactttactgctatggaacaatgttgtgagcaatgctggtacgccaaataaataacaaagtgccacaacatccattcgtacgccttgcaaaaataattgcaaccagccatctacggcggatacacgctctgattgccacacagcaagtcccaaacgggataaggaaaggatgatgagattaatcaacacgaatgtgaagatggggaataaaggaaaatgtgcttttttcattgtaaaaaccactaacacaacgacatccaagccgtattaaattaaagaaagataggcaactgtctatcggtcggttccttttcgacacaacaaaagtcttaaagtgcggtcaattttcgcatagttttactcaatctcaaatgtaaacacattcactagaaaataaagcctcgagaaaaatcgaggctttgttaagtaaacgacggaaatttaataaaaattcaccgcactttttttcgattactcttgttgtgctttcactgctgcataggcaatcatattgataatacgacgaacagatgcacctggattaagaatatgcgcagatttattcatacccattaagatcgggccaacggtaattgccgtagtggtgctgcgtaataagctataactaatacgtgatgcactcaaatcagggaacactaataaatttgcgcttcctttcaatgggctatcaggcatgacttcttttcggtgagcttcattcatcgctaaatcgccacgcatttccccatcaatcattaaatgtggattgcgctctttgacgatttgtaatacttcgcgcatttttggtgcgcctaatgaatcagacgaaccaaaattagaatgagaaagcaatgcaactgcaggttcaataccaaaacgatgaatttcttctgctgccattaaggtaatttcagctaattcttctgctgtaggattactgtttacgtgagtatctgttaagaatacgttacccgtcggtaatacaagactatttaaagcagcggcagttttcacgccgtcttttaagccaataatatcgcgaatagatgcaaggtgttttccgtatgaaccaaataaaccacatactaaagcgtctgcataacctaagctaagcaatgtagaagctaatacggtagtgttagaacgcacgacacgttttgcaatcgcaggtgtaatgcctttacgtttagtaagttcgtaatagtgtttccaacattcttcatagcgaggattatcttcgttatccacaatttcaaaatccacacctgcagttaaacgtaaaccaagttttttaattttttcttcaatcacactgcggcgaccaattaaaattggatttgccaagcccattgaaatcacttcttgggtagcgtgtaatgctttattttcttccccttccgctaaaataatgcgttgttttgccgattttgcttggctgaaaatagggcgcataaacaagttggttttgtaaacaaactgagtgagttggtcaatataaatatcccaattttgaatcggacgagttgccacaccagattccattgcagcttttgctaccgctggagcaatacgcacaatcaagcgaggatcaaatggacgaggaatcacataatccgcaccaaatgttgccccttctccaccgtaagcagaggttaccacttcgttttgctcttctaatgcaagatcagcaatggcataaactgccgcacgtttcatttcttcattaatagtggttgcgcccacatctaatgcaccacggaaaataaatgggaaacaaagcacgttatttacttggtttggataatcagaacgacctgtacatacaatcgcatcaggacgaaccgcttttgcttctggcggggtaatttcaggatttggattagctaaagcaagaataattggatgcgcagccatggttttcaccatatcttgtgtaagcgcaccagccgcagaacaacctaagaaaatatctgcatttggcatcgcatcaccaagtttacgccagccattatcttcaattgcataatcttttttggtttgatccattttgtcatcacgacctttatatactacgcctttcgagtcgcaaaccgtgatattttcacgtttcatacctaaagaaagcaataagttcaagcacgcaattgatgctgcacccgcaccagaagcaacaagtcgaacatcttcaatttttttacctacaatacgaagagaattgatgatcgcggcagcactgatgatcgctgttccatgttggtcatcatggaatacaggaatattcatacgctcacgtaatttttgttcaatataaaaacattctggtgctttaatatcttcaagatttactccaccgaaagttggctctaacgaggcaataatatccacaagtttatcgggatcatgctcattcacttcaatatcaaacacgttgatgcctgcaaattttttgaacaatacgccctttccttccattacaggtttgcccgctagcgcgccaatattgccaagtccaagcaccgctgtaccattggaaatcaccgctactaaattgccacgcgcggtatatttgtaagaggcggcaggatctttttcaatttctaaacaaggctctgccacacccggtgaataagctaaagccagatcgcgttgtgttgcgagtgattttgttggggtaacttcgatttttccaggaattggaaattcgtggaaatctaaggctgcttgacgtaattgttcgctcataataagtgctccattttcttgaaacaggattgaaatactgcgtcgattatatctgttttttattcaaaaaattgtgacgaactgcaaatcggggtaccgagccgaat

SEQ ID NO: 532 - DNA, 7828 bp, H. influenzae
  misc_feature (875)..(875): n = a, c, g, or t
ctaagcccaataaagtcgcatcttcttttaagattgtaaaaatttcatttggtgtaagcaagcccgagcgtggatagttgccatagaatataagcacaaagtgttatggcagagccgaccaaaatagagaagcgcaatgcttttacaatgccatctaagtatttatttaaccttggaatggaaccgtggaaaccaaacgccgtgaaaaatacagggcttgcagagataattaaagccttaacaattggcgtcgccattaagttatcaaatttgatttctggcaacattaagcttaacaccacggcaaaggcagcaagcataacgaaaaataacacgcgattaattttatctacgctatgtgtgccgatgacaataaatgaaccgaaaatcacggtaaataataagacgctaactttatcgccaaaactttctggtaataaatcttttagtagtgaaccgccaccgctgatataagcggcaattaatgcgtataagaaaataattagcacggctgtggcaataatgcgtcctgttttaccaaaatattgttctgcaagtgtgccgatacctgcatcactttccgcagtttgatagagttcaacgaataaaagtgcgctaaaagttaataatgcccaaagccccaataacaagactaaagtaaagccgaagccaatgccagcggaagtgagtggcatagccaacattcccgcgccaatcatcgtaccagcaacaagaagtgtgctgcctacagttttgttcatttttgtttccttatgatgtaataaaaaatttacgataattgtattgtataatttacagtctgtaaataaaatttataaattgtgaattttttactatcttccttgctatattgntgcttaagaagaaggaataaaatgatatttcctaaattttgttgtttatcaatacatttaattaccatagtttcactgtattttacgatgatattgaattgcccaaacaaatcttctaattgctcacttaatattgcctgaccattttcttattatttcctccttctggatgtaatccaatcccttgatggcgttcttgtagttttgcgataatttcgtaccactgaagatcttgattgtgtaataatacggttaagtgatagaccaaatctgtagcttcagaaatgacttccgctttatcttgtgcgaccgcagccaaggcagtttccacaccttcttcccccactttttgggcgatttttttggtaccttttgcgtgtaatgttgcagtataagaattagaaggatctgcatttttcttttcttttaaatgttgttctaattttataaaccacgcccaatttgcaaattgttgcttcttgttctctgattgtggagaggtaaattgatggaagcagctgtattcacctgtgtggcaagttgccccaatgggatcaactaaaatgagcaaagtgtcgttatcgcaatctaagctcatttcttccacatttaaaaaattgcccgagatttctccttttgtccataatcgttgtttggtacgagagaagaaagttactttacgttctttgatggtttttgtaagggcttcttcattcatatagccaagcattagtacctcacgagtacttatattttgaataataacaggaagaagaccattaactttttgccagtctattttagtaatattcattattcactccgaatctcgatggctgattgcacaaggtaggattttaactcgccaatttcaataatctgtttatggaatacgctggcagctaatgccccatctacttttgcttcaataaaagcatcacgaaaatgtaccattttacccgcaccgccagatgcaattagaggtactctacatactcctcgcaccagcttgagctgggctaaatcgtacccgtttcgtaaaccatcttgattcatcatatttagcacgatttctcctgcaccgcattgttgtacttcttttacccaatctaacaactgccaatgagtttgtcgggtacgtgtttcatcgcctgtatattggtttacccaatacttacctgtttcctgttcaaaccaactatcaatacctactacaatcgcttgtacgccaaaacgatctgctaagcgagaaatgagcgttggatcagcgagagcaggggaattaatcgaaattttatccgccccaaatgcaaacaatttttccgcatcttcaatggttttaatcccacctgctacgcaaaacggaatatcaattacctgagcgattcgttctacccaacttttatccacggtacgaccgtctgatgaagccgtaatatcataaaataccaattcatcagctccttcttgcgcatagcgttgagcaagtggcacaatatcgccaataatttcgtgggtacggaattgtaccccttttaccacctgtccatcacgtacatccaaacaaggaattatccgttttgccaacattttgatgcctccgaaagcgtaaatttttcttctaataaagcgcgacctacaattacacctgacacacctgtgccttttagagcctcaatatcagccagtgacccaatccctccagaagattgaaactgaataggtggatatttctcacaaatttcttgataaagtccaatatttgaacctgtcaaggtgccatcgcgtgaaatatcggtacataaaacttgttgtaagccaacggtttggaaatcttcgatcaacgtttctaatagtacaccactttcttcctgccaaccgctaatcgcaacgattttctgaccgcttgcattaatattcacgtctaatgctagaacaaatttttccgcaccatatttgatgaaccagtttttcaccattgaacgatgagttacggcggttgaaccaatcaccacgcgattcgcacccacagccaataaatctgccacatcttgctctgtacgaatgcctcctcccacttgtactttacattgtgttgcttcaacgatttttccaataagtgcggtttgtcttgactggggatttttcgctcccgttaaatcgactagatgtagttgttttgctccttgacgtacataattatcaaattgcttaattggattgtcagaataggtagtttgcttggcataatcgccttggtgtaaccgcacaacttgaccattgataagatcaagagcagggataataatagattgtttcattgtgtttgatcctgtatgactatatgatctagtgattaaaacggtactttttccacaaaattttttagcaacaacgcaccatttttacccgaacgttcgggatgaaattgtacaccgtaaaaattctctttcgctatcgcagcagaaaaattcacaccataattgcttattgccaccgaatgttcattcgggctaactgcataactatgcacaaaatagaagtgactattttgcacaataccatcaaataacggacagttttttacaaattgcacgcgattccatcccatttgaggtaacggtaaacccgtatcgggaattcgattagtttttccgcttattaggtttaaggtcggcacattaccctcttcggaaaattcggtcattaactgcatacccaaacaaattcctagcactggttgagttagattttgaatggtttcgatcaattgacgttcttgtaaattatacattgctgcatttgcagtgcctacgccaggtaaaatcagcttatcggcagatttgattttattgagatcaaaagtgatctcggtattgtaacctaatcggtcaaaggcgaattttacagaagaaaggttggcacaacctgtgtctataatcgtgatgtttgtcatttttttatccttttacaatcggtcgaattttgcaaaaatacgacaaaaattaaccgctctttcaactataaaactccttttgaacttggcatttcatttccttcaatccgaatcgcctgtcttaatgttctcccaaaggctttaaataagctctctattttatgatgatcgttattacccgtgacatttaaatgaatcgtggcaagcattgaaaatgccaaagattgaaagaaatgttcagtgagttccgtactaaaatcgcccactttatcgcgtttaaagcaggcattgaatttgatccaaggtctgcccgataaatctaaagcacattctgctttacattcgtccattggaagcacaaagccgaaacgggcaataccacgtttgtcaccaatggcttgtttcagtgcttgtccaagggcgagagcggtgtcctccaccgtgtgatgttcgtcaatccataaatcgcctttacactgcacgttcattctaaacccaccgtgtgtggcgatttgatcgagcatatggtcaaaaaaaccaacgccagttttgatttcatttacaccagcttcatctagccaaatctgcactttaatatcggtctctttagtttgacgaattacttctgcaaaacgtggcggacgtttgccacagtttgtgaccgtttcccccaacaatttttctgcaatcagatcccaattcattttctgtggatcgtattgaatagctcgaatacctagattttctgctaattgcacatcggtctctcggtcaccaatgacaaaagagcggtcaatatcgaataaatttttacgaatatagtgatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgtaaatgcaatgtcttattctggtctcttaaaataattccttgttcccacaatgccttaaacacagcttgcccgttttgacatttgatcaacagataattagcttcactttcatacactttttccacttgatgtaaaactaaaagagctttagcaagccattgacgattggaaagaagttcttgtgtgagagcttgaacagtggcgatgttcgcaggtcttaacgcttgttccgcaagatcagcactcggcacagggataggatatggagcgattaccttacttaagatgtcaattagctcagggtttgctaacacaaaaccacaacgcaatccagctaaagcaaaggctttagagagcgtgcggataattgctaagtgcgggtaatttttaagcaaattaataacgcttgcttcaggacagaactcaatataggcttcgtccaccaccacaatcgctttgcctgccgtgatttgcaaaagatcgagtatatctgattgcttgagcaaattacctgtcggattatttgggctgcatacaaagactacttttacatcattaagatgatttttgatttctggcaaattaagctgaaaatcgtcagttaaaggcacgctcttacttagcacacctgccgtttcagcactcactgcatacattccgtaagtcggaggacagaataaaatggcatcttgtttgggttcgcaaaaagtgtggattatcaattcaatgccttcatcaccgccacgagtaacgagtacattttcagttgaaacgcccgcataattcgcataagcctgtaccactctttgaggctgaggttcggggtagcggtttaaatccttacccgaaagctgaaattcaggcgaggttggatattcatttgcattcagccaaatcgtaccattgccgccgagttttcgagcggattgatatggcgttaaggcttgtatattttgtcgggataaagttgtgattgtcattattgttttcttccattgtaaaatgtgcgaattgtaatcattcatacatatttcgtattgttgtatgaaaatttgactgcttacgtgtcgtgcttagatctacaattaatatcttagatattgagtttcgccaatcttacacttactgccattttatgtgctgccaattgctcagcttctgccatcacttccaccgtttcagcaaggtttttaaaaccttttggtgtgagttcttgtactgtcattcgcttactaaaatcagctaatcctagactagaataagttttggtgtaaccataagtaggcaaaacgtggtttgtgccactggcataatcgcccatactttcaggcgaatatgcacctaagaaaattgagcctgcgttatctaaatatggtaataatttacgggcgttttttgtttgcacaattaaatgttcaggggcatattcattgctaatttctaccgcttgttcaaggctttctgctataaaaatacggctgtggtttaacgcttttcgagcggtttcagcacgaggtaatagagcaagttggcgttcaatcgcaagtgcggtctcttttgccagagtttcacaggtcgccaccaaaatcacttggctatctgccccatgttccgcttgagagagtaaatcgcttgccacaaattcaggatctgccgattcatctgcaattactaacacttctgaaggtcccgctggcatatcaatcgccgtactattttgtgctacctgacgttttgcttctgtcacaaatgcgtttccaggtccgaaaattttatctactttcgccacactttccgtgccttgagccatcgcaaaaactgcttgagcaccacctatagcgtagatagtttccacaccgcaaagatgagcagtgtagagaatttcatctgagatcggtggcggtgaacaaagcacgatttttttacaacctgcaattttagcaggaatagctaacatcaatacggtggaaaacagcggtgctgaaccacccggaatataaagccctacacaagaaattggacgagtcacaacttggcaacgcacgccttcttggatctctaggtcaatttcctgattttgctgtgctttgtgaaaggcttcaatgttcgttttggcttgctcaatcgcattgcgaagttttacagaaatccgactgcttgccgcttgaatttcatctgccgaaacaatgagtttatctaacttcacgccatcaaatttttcacagagttcaaataacgcccgatcgccattgtatgccacattttcacgaatggcattaactgcctgctgaatgttttccccattttgttggactggacgcataatgactttgcgtttttcagtttctgataaatgattccaaataattgtttgcattgtttattttcctttgtatccgtaaaatggatgataacccaccattttgagatattgattatttaaatggcgagtcaaagctcgcactacatttactccatcatcttctcaattggtaacactaaaattgaactagctcctgcctcttttaactgttccattgtttcccaaaataaattttcttggctcactacgtgcattgctacccgagttgtatcactggctaatggtaaaatggtcggattttcaacgccaggtaaaagcgcagtgattttt

SEQ ID NO: 533 - DNA, 6580 bp, H. influenzae
aatttaaacgtgtatataaatgttgtataagtttgggtaataaggtttgtcggtctacatcaggatcaatttcacacacttccgcataaggctgactaatttctgtttgttttgacaacgacgcattaatacctacgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaacgtccaataaaaactaaacatgatttgcccagcaaaaggcgataaccattggcgaccacgccgaccgcgccctgcagtttgatattcagccacacaaagatcacctttttttaaggaaggaatattttgtagtatccactcatttgtagaggaaattatcggctgataatggatgccataaggaaaaagtgcggttgatatttgctgaggatttaataaaggaagcattggcactaagcgataatcttgtccatcaacgagaatatccaaaccaatttcacgtaattgttgaatatcttcctctagatttttagtaaaatttttccaattcagaccgcacttttgtctgacaatccgctaaatatgtcaataacgtaaaattcatcattcattccttatggcaaatagtatgaaaatcatagcataaatcctaaaatttcgttttcaaaataaagtgaaatctgtataatctcgtcgcaatattttttaacttcaacttagcgagaatattgcaatgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattactaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggctaatctttaaggtgggctttagcctgccttttgctgtttaaagtgcggttggtttttgcaaagttttaaataatatgaaccgcttacactatcaataataagagcattataaatgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaatagaaaatctctatttcagataatttctaattatttcagtaactttaataagtgcggttaatttttaccgcactttatttttgtttaaaagcccttctatgccaatcacaatgagacttaaccaaataggcacataagtaaaatagtcgcttgtggttatttgattatccagcacaaagacagctattaaaaaaagcagtatgggttcaatataactcaacaccgcaaaaatactaactggaatttgttggctggattttaagttggctgaaagcgaaatcgcactcacaataccaagtgctggtagcaataaccaataacgatattcttgcgtaaccaaagaaagcgtatcgctttgagaaagaatataaataaaccaaggaatcgaaattaaaataatatccaatgtaattccttgtagagcagggattttcatcaatttacggcttagataataaaatggataaaccgtacaaacccacaaacttgtccatgaaaaactttgagtgtgccataattcatgtgcaacaccgcaggcagccagtaaaagcgcgattttctgaataaatgataaacgttcttttaaccaagcccatcctaaaacagccataatcagcggaaaaagaaaatatcccatcgcaatatttatcccttcaccatttagcggagcccacataaagagccagaattgacttcccgcatctaatgtccccagtaaaaataaaacccaacgcgtccaactttttcctaacgttgtcgtgataagagacaaaagagagcggcaaccaatagtcgggaataaaattaaaagtaacccaaagatcatggtcagcatacgccacgcaaaaacatccgttccgctaagtggttggagccatatactaaataaatacaatatgccaaataaacattgtgaaaaaatgcacaataatacaccttgagtaactactttcattttgaacctcatctcatcaatgtgattattataaaatcccaagacaataaaaaatctcaactttattttttattgtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaccattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattaacttagttttgtcgtctgttttaagaataaataaccaagtattgccgaaacagttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatctggtaatttagctaatcccaatttaacagaaagataactaaatccaaatataccgactggtttaccaataattaaaccgcttgctatagccaataataatggcgacgaaatcatattcacatctatgccagcaaaactcacaccagcattggcaaatgcgaaaagtggtaaaataacgaaagatgaccaagaggataaaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcggaaactttgaaacgatttagtaatatcagcacaataattgccacggcagaaaaaattagtgcttgtacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgctgataggtagaaagcgcgccttcaaataattcttttttgacttccattcccactaatacaaaaaacaccgccataaaaccatcgttaatccagtgaattaaggttttattaattgagaaactaccaatttgtaaacttacag

SEQ ID NO: 534 - DNA, 8189 bp, H. influenzae
tgctggctgattacaacctcggttccttggttatttaccaaaacgtgggagaagaaattattttgtatttatcttcaatttaaagtgacttctgcagatagtcgtcgattaattcaacttcgcgtgacagtgccagatgaacatttggcagaaatgaataatgtagatgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatcttgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaaaggttgttttttgcaacggataacgctgtcttcctgactgccacgaagctcggcttcttctaatgcaagtaaccaatgcggcaaattatcttgaaggatccaattggttaaaatcgtgctaggttcattagcaaaggctaaaggcacgacagggagcgaacctaaggatttacgcagtaatgcgagcgcatcttccgcgcgtttacttgatgcggcatcaatatgaataagattattttccatatcaatccatagtgccgtatgctgatttttactaaatgcacgaggtaataaattcatcacgacatcatcttttaatgtttgtttttctacctttttaagtttgcgattttctttttttcaaggctttcaatgcgttcatcaagttcacgtttgaccacatttgccggcaagattttttcttcttttttggcgattaatagaatttgttttccaacagaaaaatagagtaaatcagaacctcgtaatggggctgaccagccaaatttactttgatcttgagcaccgcagggatggaattgacaatcttctagttgagtttgtagttgtgtaagatcccaatctagcggtttagtcagtctataagtcattaaatttttgaaccaaaaattaactttataactcataacatttcaccatgtacaattttatcattaaatcaataatttacttatttcaaaacaccatttataattcatagtatatcatcatatttcaattttttagtaaccataatggtaacttatcacaatcaagctagatttcttggttactaaaaaatatattaatacctatttttatatacataaacagatgtcttatggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactggcattacaacgacaaaacaatacattttttgccatatcaactcaatggaaacaaaaaaaagttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatctaaaaataaagggaatcaatactgattccctttatttacctaacctttcttcagtaactctaccatttctctcagtagctttatttcattatctttttgctctactagcttattcaacaaaccttctttttcttccaataattgctgacaatgtgataacgataattttagtttttcaatctcaatcaatagagatttctcattgtctccctgaaatgacgaactaaaatgagaattctcattgaattgaacgaagacatttcgttcaccagaattaatcaattcaacaatatctatatctaaaatctgtgcaatttgctctagcttatccagatgtaatttcgtttcaccacgttcaatttttgcatagccattcaatgacatactcattctttcagccatctcttcttgtgaccaatgctttgtttcacgtagttttctgatcttttcatgtacgttcattcttatacccataaataggttaattttttacaacaaactgtgtgctaactatacatcgattgttggtagaacgcaaaatctctcttagataaaatttacaaatacaactatactggggatatttatgcttaaatctatacttaaaccaataggacatatactaaaacttctaataaaaactgctttattcttactttcattattattcatactaatgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaattataggtgtaactatgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgttaatatttactttaatggaatcttaaaatgaataaatttttattacatctatatttctaataacaaatattacatatgcaggaatccgtactattgaacttccgccagaacaatccggttcaatagctatgaaatgtggagactatatttattttggtgaaaaagttcatcttacgatgtctgcatgataaccagcttgttaaaaacatatgaacaaggccaatgtattacctcatgatgaatacaaactttttaaaaaagaatgtacaactaaacccgacaatgtttcacaagcctacaaaatgagaaattcatctaactatgtggaaactcccaaaaactgatggtttgtaccaatggatagtgaaactcaatacgcttatgaactcaaaatgaacctttcttaatttatggatcaccatagggtctatattctaaagaataatggccctaacattttcataattattgtgtttcattaatacctttatttctttcgtggtgggtcttatatgagtcaaattct

SEQ ID NO: 535 - DNA, 7499 bp, H. influenzae
agctgttgaagaaaccattcaataataaaaccaaaatgcggtattaattgagattctttccaccaatcagtttgttcaaaattggtaaaagtatccataaaaaataacaacgcagccacaatcaatgcaccgcgcactaaaccgaaagcagcacctaatacgcgatcagtgccgcttaaacccggcttaactactaattgactaatcacataatttactattgcgcccacgattaaagtcagaacaaacagaatggcgattgcagttccattacgcacatacattgattcaatttgcgtaagataagtggcaagataaggatagaactggcttgctacgataaatgccacaacccagctaccaagtgaaagtacttcgcgtacaaaaccacgtaataagctgacaagaatggaaaaagcgataatgccaataataatgtaatcgatcattaaaaaatctctcaatgaaaaacggccgtttaaaacgaccgaggtattctacaaaaatacagccaaaaagaaaacgtttgcgtaaactaaatttcctgccaaaaagcacgttcaaatttgctttgagctttccttaagacttccgctaaatgttgatatgtcggtttttcttgcacaaaaggcaagggttcattttgttgttttaagcgttcgcaaatatcgtaaaaccataccgcactttgattttctaatggcgaatttgcacgcttaccaagccaataaagcccttgaaaaggaataagcaaggcaaaaagtgcggtcaaaattgcgatagaaaatgccattaaatcattttttgcataaatctgttgccacagtattgcaaatacagcaacaaaaggcataaatttttgtgcaaaactcgtggctttcataatacggttttcagggaaaataatccctaacttcgcctcctgcggccaagtattaagataaatttgtccctgtttaaaaatggaaaaaaacgccataaaaaacacctcaaaaaattgaccgcacttatcatacgctattttaagtctatttttagtaaaaatagtttaatttttcaaaaaatacgataaagtttgtattttttccttaccgatgaatttattttattcatcaaaaggtgtatcctatacctaatttttcaaaccatcttaaatgatggatttctattaacctcaatcaaatatagggttcctatgtcaaaacttgttcttatccttaactgcggtagttcttcactaaaatttgcaattcttgatccagcaacaggggaagaaaaattatctggcttagccgaagcatttttcttaccagaagcacgtatcaaatggaaactcaatggagagaaaggtaacgcagatttaggcgcaggcgcagcgcatactgaagcgcttaattttattgcatctaacattctgactgatgaactaaaaaattctatcgcagcaattggtcaccgtatcgttcacggtggcgaaaaatacacccaatctgttatcgtaactgatgaagttgttaaaggtattgaagatgctgcacaatttgcgccacttcacaatccagctcacttaattggtattcgcgaagcatttaacgcattcccacacttaaaagataaaaacgtggtagtttttgatacagcattccaccaaactatgtctgaagaagcattcctttatgcccttccatactctttatataaagaacacggcgtacgtcgctatggtgcacacggcacaagtcactacttcatttctcgtgaagtcgctgaatatgtaggcaaacccgcagaccaagtcaatgctattatttgtcacttaggtaatggtggttctgtttctgttgtgcgtaacggtcaatgtatcgatacgtcaatgggtttaactccactagaaggtttggtaatgggtacgcgttgtggcgatattgaccctgcaatcgtattctatctatacaaaacactaggtatgtctatggaacaaatcgaagagactttagtgaaaaaatctggtcttttaggtttaactgaagtaaccagcgactgccgttatgctgaagataactacgataatgcatctaaaccagaagcaaaacgcgctttaaatgtttatagctatcgtttagcgaaatacattggtgcttatatggctgtgttgggcgatgatcacttagatgcgattgcattcactggtggtattggcgaaaactcagcgcacgttcgtgaattagcattgaatcacttaaaattatttggcattaaaattgataatgaacgaaatcttgccgcacgttttggtaaagatggcgtaatcacgactgatgattccgcatttaaagcgattgttcttccaactaacgaagaattggttatcgcacaagataccgcaagactttgtttctaattcaacaacaaactgccgaatttttcggcagtttttatttataacatatacatattaaggtttaactatgtctcgcacgattattcttatccctgtaagtacaggcgtgggtttaactagcattagtcttggattaatccactctctcgaacaaaaaggcacaaaagttgcttttatgaaacccgtttctcaaccaagcactggcgaagataaattggatcgcacaacctctattattcgcactagcactagccttgaaactgccgaaccctttatgttaagcgtggcagaatcattaattggtcaaaatcagtctgacgtattgttagaaaaaattgtagctaaccaccaacaattaaccaaaaacaacgatatcgttgtggtggaaggtttaattccaacaagaaaacacggttatgcaaataatatcaactatgaaattgcacaagcattagatgcagaaatcgtattagttgcagcaccagcaactgaaaccccaaccgaattaaaagatcgtgtagaagcagcagcctctttatttggtggtaaaaacaatccaaatcttttaggcgtagttgtaaacaaattcaatgcacctgttgatgaatctggtcgtacacgccccgatcttgctgaaatctttgattcattccaacacaatcatattagcgaaacagaagtaaacaaattatttgcaggtagtgccatcaagttattagcttgtgtgccttggaatgcaaatttaatcgctacacgagcaatcgacttagtcaaacatttaggtgcatcaatcattaatgaaggggaaatcaatcgccgtattcgtggtatcactttctgcgcaagaagtttaccaaatatggttgagcatttccgtgcaggcagtttattagtcgcttcagcagatcgtccagatgtgcttgtagcagccgctctcgcagcgtcaaatggtattgaaatcggcggtattttattaacaggcggttataaaattgatgctcaaattaataaactttgccaacctacttttgaaaaagcaaaattgccgatcttccgtacttgaaggcaatacttggcaaacggcattaagtttacaaagctttaatcttgaagtgcctgttgatgacaaagaacgtattgagaatattaaacaatacattagccaacactttaatgctgactttatcaataatttagttgcagattctagccgtttacctcgcttatccccacctgcattccgtttccaattaactgaacttgctcgtgcggcgaaaaaacgtattgtgcttcctgaaggcgatgaacctcgtacaatcaaagcagccgtactttgcgcagaacgtggcattgcggaatgtgtgcttttagcagatcctgcatccgttcaacgtgttgcagaagcacaaggtgttaaattaggtaaaggcattacaatcattaacccagcagatgttcgagaaaactatgttgatcgtttagttgaattacgtaaagcgaaaggcatgaccgaaaccgcagcacgtgaacaattagaagataccgtagtgcttggtactatgatgttagaagcaaatgaagtagatggtttagtatctggtgccgttcacacgactgcaaacaccattcgcccaccaatgcagatcatcaaaactgcaccaggtagttcaatcgtttcttctatcttctttatgttattaccagatcaagtacttgtttacggtgactgtgcggtaaacccagatccaactgcagaacaacttgcggaaatcgcaattcaatctgcggattctgcgaaagcatttggtattgatccaaaagtcgcaatgatctcttactcaacaggtacatctggtagcggtgctgatgtggaaaaagtgaaagaagcaacccgtattgcgaaagaaaaacgccctgatttattaatcgatggcccattacaatacgatgcagctgtgatggaagacgtggctcgctctaaagcaccaaattcaccagtagcaggtaaagcaacagtattcgtattccctgacttaaatacgggtaacaccacttacaaagcagtacaacgttctgcagatttagtgtctattggcccaatgcttcaaggtatgcgtaaaccagtcaatgacttgtctcgcggtgccttagttgatgatattgtatacacaattgccttaaccgcaattcaagcaacacaatagttcatacaaaattgtaaaagaaaataccgcactttgccctaggcagtaaaagtgcggtatttttttataacgtttttttacaaatcaaccaaaatcaaaattgcggcttcaccgccccattctcttggcgcttgatgcaatgcccgcactttaggatgttgtactagccaacgtggaatttgttttttcaatgtaaaggtgccatagcccgtcatgatactggcacaatcaatatgctcattttcacaagccagtaaaagtgcggctaattcttgcttagcttgttcacgggttaaaccgtgtaaatctaaaaacaattctggcgaaaaatctccacgacgaagttgttttaataaatgggaatcttccccatcacgtaaatatttcacaacaccatcatgctcattcagtaacggctcatattcatcagaaaaataaaataacgtatcttctttcgctcgtaattctttcaattctatttttttctgatcacgtttttggtgaggggcaacaaaagtatcttgtttcattggcttaatgcctttggtttccgcacggaataaatcaaattcgtcttgcatttttttctcattaatttcaaattttgcgtatcatatcatagttctacattctcatctgtggtataactacgccaaattttcataccgaattttatgctaacttttctactcacttttatggagaaatgcgatggaaacttcacataaccaagaattagttgcaactatcttggaagataatgttgcaaacgaactgcaaaccatccaagattttctgcgttggacgtatagcattctcaatcgttctgatatttacttcgggcaagggcacgataatccttgggatgaaagcctgcaactcgttttaagtggcttacatttacccattgatttacctaccgaattatttaacagtcgattaaccccatctgaaaaagaaaccttagttcaacttgtattaacccgaatcgaacaacgcatacctgtggcatatttaacgaatagcgcttggttctgcggtcacgaattttatgtcgatgaacgaaccattattccacgttctccaattagtgctttaattcaagatcgctttgaagatttaatttcacaagaaccaaatcatattctcgatctatgcacaggcagcggttgtattgccattgcttgtgcttatgctttcccgaatgcggaagtagatgcggtagatttatcggttgatgcacttaatgtcgcagagatcaatatttcacgccatcaattagagcatcgtgtattcccgattcaatcaaacttatttgaaaatattttgggacagaaatacgatcttatcgtgaccaatccaccttatgtggatgaagaagatctcgccgatatgccagaagaattccattttgaaccagagttagccttaggttctggcagtgatggcttaaacattaccaaacaaattttgaaacaagcaccagattacttaaccgaaaatggcgtgttggtgtgtgaagtgggtaatagtatgattagcttaattgagcaatatccagatgtaccatttgaatgggtagaacttaaaaatggcggactaggcgtatttgctattcagcgtaaagatttagtgaaatatcacgatctgttttaatctttcaagtgcggttaaaattcttattaaatttcaaccgcacttcatttatacattgttatcttgtttccaattcaatgccttcaaataattttttcactgaattgttatcacgcaaacgctcggctttttctacgacactacgaattaagtgcggtgaaaaatattccataaaatcgtacatataattacgtaagaacgtgctatgtttaaatgcaatattcgtcatactcgggcggaacaaatggcttgcatcaattagcacaagatccgcatctaatgccgtatgcgccatagatgccataatgcccacccctaaacccaagcgcacataagttttaataacatcagcatcggtagccgtaaaaactatatttggtaaaatgcctgcactattaaatgcgtaatctaaatcagaaacacccgtaaaaccaaacgtgtaagtcacaagtgggtatttgcctaattcctcaatggtcagttctttcactttggcaagcggatgttctggcgaaacaatcacggcacgattccaccaatagcatggaatctgaactaaatcatcaaataaataaggtgcttcagtggtaattgccaaatccacttcacctgacattaaagcatcgtgaatttgtgttggcgaaccttgatgaatatgcaagctcacatcaggatattttttagaaaaacgttcaatcacgcttggcagcatataacgtgcctgagtatttgtcgtcgcaatacgtaatacaccgtgatttggccgagtatattcatcggcaacggcacggataccttgcgctttaacaagtaactcgcgtgcaattgagataatctttttccctgctggtgtaattgattttatatgcttgccatgacgctcaaaaatttccagacctaattcatcttctaataggcgaacttgtttactgatacccggctgtgatgtgtaaagtgcatttgccgcttctgtgacattcaaattttggtttacaatctcaacgatataacgcaattgatgcattttcataaaaaaggccttattttttataacggttgttcatctccgaaaacggtttaccggcttacgaatttgcccagattttggacgaccaccaacctgggttacatcgtatttcggttccagtcccacagggtaatcccaccattcccagaaataaattggcgttttgcagaatacatttttttcccaccccccaagggcaatctcttcttag

SEQ ID NO: 536 - DNA, 7977 bp, H. influenzae
  misc_feature (4108)..(4108): n = a, c, g, or t
  misc_feature (7960)..(7960): n = a, c, g, or t
gccagacttgctgcctgcggtcgactctataggacccccaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataaaaatatcttcagatctgaccgcacttttaaagtgcggttgtttttttcgtaaatttaacgagaaatattatgcaaaactccaccttatacccaacggtttatgtacttggcaacggacaactcggcagaatgttaggttacgctggtgcacctttagatatttatgttgaacccttagccttcaatgcgccagtttttgacttacctgaaaatgcgatcatcacggcagaaattgaacgctgggaaaaaacacctttgactgaattactcggcaatcataaaaacttcgttaatcaacatgtatttggattattagccgatcgttttgctcaaaaatccttgcttgatgaactcaatctttctacctcgccttggtgtttattaaaagataaaacgcaatggaatgatgttttccaaactgttggcgagaaagtcgtcgtcaaacgtagaacaggcggatatgatgggcgtggtcaatggattatcagcgatgaaaacaaagcggacatcactgatgacttatttggtgaagtgatcgcagaaaaatttattccttttgattatgaagtttctattgtaggcgcaagatttaaaaatggcgaaaagcgtttttatcccgttacgcataacctgcaacaaaatggtattttgcgttacagtgtgattgataatgcatttcctcaacaatccgcacaacaaaaacaagctgaaacaatgctcggcaaaattatggataagttaggctatgtgggtgtgatggcaatggaatgttttgttgtaggcgacaaattactaattaacgaacttgcgcctcgcgtacataacagtggacattggacacaactgggatgtgctattagtcaatttgaattacatttacgcacgctacttgatttgccaacacctgacttacaaatttttgccccaagtgtaatggtaaatttaatcggcacaaaccataatccaaaatggcttaatataccttttgcacaacttcattggtacggtaaagaagtgagggctgggcgtaaggttgggcatatcaatctttctcatcctaataaagcggtcattattcaacaattagaaaagctccgaattgaattacccgaagattatcaatcaggattaaattgggcgattgaaaaactaaaataatgtaaaaaatgaccgcactttttgataaatatttaaaaatattaaagtgcggttaatttttataaaaatctttcttgataaaataaaacggctgaagtataaaattatccatcacacaactgatacataaggaaaagctatgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaatagggttagaaataatatatcctctaaaatattgtaagtaaaaaataaagccttgattatcaaggctttaattttatttaatcattaacaaattctcggcaatggttcatttgttggtaaatctaataatttctgtggctaattcgttaataaatccatgatgatgggatgaaatcaacatgggtaaggaaagctcacgcaaaagtgcggtcaatttttcagtattttttcgatctaatccattggtgggttcatctaataataaaatttttggctgcatcgctaagacaccagcaagtgccgtgaaatttttctcaccaccagatagggtatgcaccatacgatcttttaaacctgtgataccaagacgttctaattgctgctctgcgatatgatacgcctgctctctgggcatattttggtttaatggcccgaaggcaacatcatccaacactgttgggccaaaaagttgatcatcggcattttgaaaacaaataccaatcgtgccacgaaagggcgcaaaatctttttcttcacgacaaactttgccaaataatttaatttcccctttggttacaggaacaaatcccaacaaagcaagcagtaaagtggtttttcctgaaccaatttccccttgtacgaagaggcgtttttgaccttccaaggtaaaactcaaatcttgaataatcgctctaccattgcgttctatacaaagattatttacagctaacatattatttttctctctttttgccaaactgaaaaccacgacattttaacgccatttgcgccgtttcggcttttaatagggcatggatcaataataaagcgacactttgagccgtcacataaagggttcggcgattaagcccaggacgaaatccacgagctcgcatggcaatatccattttttgacgcagttcgccaagcagtgcaatgtaacgtacggtcagcacaaaaagttgaattaatttttctggcaaaggcaatttaccaatggcttgaacaagtactgcatcattaatattccacaaaaaaagccaaagagaaatcaacaataaatgagtccgcaaactcaatttttctgctaattcaatgccttgaaaattgagttcaatgccattttctccaatttgccaacttaatgccgcccacattaaagcaataaaaatgactaaagcaaaccaacgtttaagataaggcaaaaaagatttttgactgagctgcagtgaaataaaaaagagagaaactgcaagcacattaagggagataagccaagtaagatcactcaatccactaatgattagcccccagataaacagantaatcaaccctaagtgcggttgaataagcgatgaattttcattaagagaaattctcggtacgattcatgacttcaggatacattttaccaagcaaggtaatcacccctacgctgataatactatccaaaacaaatactggaatatgagagactagcaagagccaaacaagattcagataacttttcccaccatctaacatcagcacaaaagaagcaagcacgcctgctccgccaacgccaattacgccagcaccaataccgactaataagcgatcttttaatgccatttgtggctgtaaacgagaacggaaaagataataagcgatcacagctggtattgccatcacgcaaagattgacacctaacacggcaaatccaccaaaagaaaagaaaatgacttgcaataaaagtgcgatgaggaatgctggaaaaacggcccacccaagaaataaaccagccatgccatttaaaattaaatgcacgctaccaattcctacaggcacatgaatggttcctgccacaaaaaatgcagcggcaaaaagtgcggtgagcggtaaacgttctgattctaaacgacgtacccccacagcaatgcccgcaacagcaagcactgcaccagctaataaaataggcgtatgtaacacgccttcagataaatgcattaaatacgtccttgtttaattttacgcgcattacgtaaagcaataagtccagcaataccaacgatataaccgattccacctaaaatatcatgcaaataaattttatcttttaaatgcgcaatatcttcacgaagcagcattaaatctgcactgctttgattttcggcagacgtatgagcagcagcaacaacggacgcacggtgtccttcatcgccttccaccacaacttttaaggttgtatgtggtacatcagcaatagaaagcttaaatgcaccttggcggtctgtttttccagttaaaacgggatcagaaacacctgagcggaaaacttctaaataagtttcagctgctggggtcatatcagaataataggatttgccagaaagtgtttgcccatcatattgggcaaacacataaagcgcgtgggcataagcattcgggagatagcaagccgcaaaaagtgcggttaaaaaagcaaattttttcatcccaaatccatattattgcgcatcaaaagttagcatatattccacagttcgacgatcgtaatctgcattatttgttactttttcctcaaactctgcccatactttgttgaagcctttagttggggtaaattgagcgatacctttttcattagttaaattgaacggtgcatcttcactcacacccactttaatgccttgaactggtttaccattatgtaaaacaaggatagaaagtggtttattcgcttgtgctttttcttgaggaatcaattcgtatgcttgttgatgagatttgaaagattcagcatcccatttcaaaatcgctttaccaaatttaacaggattagtactaaattctgctgttggttcttcacgttttgttttttcaacgtatttaccgcttggtaattttgaccatacaccattatcgaaatgaacgaaaaactaattctgatttaggcaaagattaggcttcgccatttctgaattggaatcaacagcagttaatttgccttgcgcatttaaggcttggagagatttaagtttagattctggtgaggtttcagtttgttcatgtccaaatttcactcggtattcatcttgcgatgaagcaggctcaagccaaacattatgtgcgttagcaacagacatacctaaaagtgcggttaatcctacagcgatttttttcaattccattttggatactccttgtttgtttaagaaaatctaggcgtatgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgtactttaggcaattttcggcaatataatgaagaacacttgcaacgtttatcatttatttgtaactgccgaaatttagatatttcattaagtgaaataaaaagcctactgaatttagaaaatgcctccaaacaacaagcagaagaaattaatcgtgtgttagataaacacattaaagaggtggcaacaaggattcacgaactcgcccatttacggatgaaattaattgaattacgtgaaaaaacagtctcgaatgatgaagatccaatgaaattgctattgcaacatagtggcgtgaaatttgtgcgattaaaatagccgcacttttaagattatggctgactagataaacgctgttttgcttccttattgcctaattcagctgcttttttcagccattccaatgatttttcaggttggttttgtaagcgataaatattacttaacatcatcatcgcatccgtatctttagctcgagctgtacgttcaaaaagcttaatggcttgctctgtattttgtttgacgtaatcgccacgtagatacataacgccaaggttatttagccctttcacactacccttctctgccgcttcgctaaaccaccaataagccttttcatagtctctcaccgtgccacgcccaaggttatataacatacctagattgctttgagcagtggtgtttccctctaacgccatcggatacatgatatcgaaaacagagctccattgctgtttattggcaaactcttgcgccaaattcattcttgcttgatcatccattttcgaattcgctgtaatatcaatggttttcatcgcccaaacaggcaaactaaaacaaagtaatactatatgaaaaaataacttcagtttcatttacaaggttgctactaaaagtaaaataaaaaatacggcagtaatcgcaaattctgttagtccaacttgcataacagaaagctttttagtgggcagataaaccgctcgcactaatccaggcacaaaagctaatgctaaaataaattgttgcgaaaccacaaaaatcagcacacataataagtgaaaaatcactgatgcccaaaaataacgtggattttttcgttcacgcatcattgattttacataaagtgttgttccaataaaaaataatgttggataaatcgccacccaaagtattttttcatcaaaagtgcggtcagaaaagtaataggatcccattccagctagggcaaaaattaagatccctgccaagtcattccataaattgcgctcatcttttttcttggtgaaataaatattcaccgcaacaaacggtaacatggcaaacataaaatacaacacctgccaattataaattaacgcgggaatcgcaaaaatcacggcggcagcaaaataaatcacagaccattttttatataactcaagatttttacctttaaacaaattcaaaaaaggataagtcatcaaataaagcgaaaaccatcctaataataaaaacatgtgcgcccatactggattagcaagcaacataccataaataaaaggcagtagtgccataacaatagcaccgtgctgattagagataagcagtttcataataattaaataattgagaataattgtcggatattttagcctagtaaagaggattttacaaagcagtaaaggctatttagaatagaagaaaacaccccaaaggagaaccctatgacaattcaacgcattttacccaatgcacgtttaagtgaagtttcaattcataacaacctcgcctattttgcagggcaagttccagaattaaccatcgagcaaaatacctacgaacaacccnagaagtattaggtttac

SEQ ID NO: 537 - DNA, 7265 bp, H. influenzae
ctgttaacgaattcggactcggtaccctaaaaataaagctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaatcttagtaatagacttaataatatattcacgctaaggcaaaaaaatctattactaaaacagcatagagacttgtaaatactaggattaacgcctagtttgttatattactaagtagggctattttatggcatacttaacaaatccgctttctgacgcccaaattaaaaaagcaaaactgaaagaaaaagattgctcctacttttacaaacgattcacgaatacatccataactaaaaggactaagccctgtagattacagagcttagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagatacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgcaccttcagaaataaaacataaaccaagaacaaatgatgctttccccgcatcgcgttggctaacggtaaatttattgcgagcaatccaagtcgcaactgtcataccaattggaggaaccatacctgcggccattgccgcagccattggtgtataaacttgggaggcaatcaatccaacagaaaaagtgtacgctgctttatttactggtccgcccatatcgatacacatcattgcgccgataattacgcctaacacaatcgcattcacttcgcccattgaagtaagccaattacttagctctttcataatttcagccactggtggattgatgaggtaaatcatcgtcaaaccaacaatcatcgaacccaagagcggtaaaattaaaatcggttttaatgaagtcaggcttgctggcaatcgaataatcacatttagccctttcaccacatagccggctaagaaacctgcaataataccgccaagaatccctgcacccgcttcacttgccagcatccctgcaatcaaaccaactgcaagtcctggacgatcagcgatagaaaatgcaacgtaaccagcaaacacggcaatcattaacttgaacgccacaccactaccgatattaatcaacatattaggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgccttatcaaattcttgctcagttttcttcaaggctaatcctgttgaagtgcggtatattggtttacctttaaatttatctaaaggcacgtcaatatctgctgcaacaaataccaaatcagccgccgcgacttcttctgcagtaatttcattgccagccccaacttgaccacgggtttcaacttttacattccaaccttgttttttcgcataggcttcaatcgcttcggctgacataaacgtatgtgcaacgccagttggacaagccgttaccgcaacaatattttttacaccagaaacacctgtaaaactcaccgcacttttcggtgcaacataatcagccccattcgctaaggcatttgccaatgttacttcaggagaaatcatggcgatagcttcgccgataataaagacttttttaccaactaacgcagggttatttggtaatacagaaccaaatacaagaacaagatctgcttcggctggtgtttctacaatagagacatttgctttttgtgcagctgctcgaaaaacttcatgtaataaataggctttcgcatcgcctacattagctgattgggttaaaaataacttcatactatccttcaatcatcgttatttgtactttttctaaaatggggtcaagtaaactcaaatcactcacaccgacgttactctgagataccgcaaaagcggacacagccgtagcaaaagctaaggtttctgttttcgataaacctttttcaaaaccatagattaagcctgctaccattgaatcccctgctccaacggtactcacgacattttcacattttgctggttcggctttaagcacgccttcattattaatccataaagaaccttttgcgcccattgaaataatcacgttttcaatgccttccgctttgagttgctgtgcagcggcaataatttcttcaagactatttaatgaatgaccaacccaagcctcaagttctcgatgattgggttttactagccaaggtttcgcttttaatccagcggtaagcgcagcattgctactatcaagcaccactttaacgccagcttgatgaagctgatttaaccaatcagcaaacaattcaggagacacacctcgaggtaaactgccacaaactgcgacaatgtcataatctaaacaataagccaaagaatccgtcacaaattgttgccaaatttgtgggcttatttgatatcccaagaaatttaaatctgtcacatccgcttcagtctcggtaatttttacattgatacgtgttttgccattaacacggtggaatttatctttcaaaccgtgctgattaaacatttgctcgaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcgctgattccgtcaatagcttgttgcgcttcttcgcccgtcgcaacaaaacgtaaacgagtccctttgactacgcctaatgctacaattttcatcaaacttttagcactgactaattgagaattacgatcaaggttttgaactgctacggaagcattatatttcttcacttcatttaccaatattgcacttggacgagcatgcaaaccttgctcgtttttaatcacaaatacggcttcaatggcatttgccggcaaattatcatcttctgttaccgcaggtgtgtgaatttgatcgcccataatctcaatggtatcgggttcagacggtggcactaccgaaacattctcgcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaatcgtaaaggttcctacaacagcaccttctacagattgagtttcaacatcactcgatgaacccaaaagtgcggtcaaaatttctgttgaatttccattgagcaaggttgtttggacatcgtcatctaataaacgcgccaaagttggattaatttgatcaccgacggctgaaacggttatcacgccttttacggccttgccattgtggctaaaaatcgttttggcacgactaaatgctaaggcatttttcacatttcctacgacagagtccgttacccataaccctttgccaagtggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcagtatcttcatcgctcaatacatgggttagttggcgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccatgaggaatagcgatgccattgcctaaaaaggttgaggtttgcagctcgcgcgctaacattccttgcaagtaaccattttcaacattgcctgcttgaaccaatgcggacgctgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgccagtgtaaagtttatcctgaatttgtttcactggaactaaaatacggcttaaataccagtcattcgcaccacttgcaaaattatctacaaagaaattttcattccacgcgacctttatatgtcgccacagtcgcttcataagcagctgcataagatttttgatcgattttatctttatctaaatcaatcacttttttatcgttccccataaatggaatatggttagtaaccgatgaccaagaagaacaacctgccaatattaacgtaaaaaataaaacagagatttttttaaacatagtcatacctgattaaagttaataaaacgccgccattatactgtctgaaggggattaagcaaggaagcctgtaaggcttatctaggcaaatgttaatttcgtataaaatcagtaaaatcagaccattgctcaatacgaaaagcgcgaatatctcgtaccgactgagaaatccacgccaactgttttagtgcattcattgcctgaaagagattcgccatatcttcattcatgttggtatataaacttccttgtgttctaacaaaaccaaattttgctaaaactgcgccaatgtctgtataagcctcttgaacgccctttggatgataatcttgagtgtcttttacaactaaatcaaaagcaatcgcgtacataattttccttattcagcttcgggatcttcaagtaggtaagataagcgataaatgtctttttctccagattgtaacaatgtgatatttaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttttaatggcgttgcgccatcaatcagccacgagttttcatcacggctcacaatatattcttcttcgttagaaaccaattcccccataacaatactcatcacatcatttagcgtaacaatacccaccacaagagcatattcattcacaataatcgcaaaatcttcgccagtagatttaaacaattccaacacttcgtaaagagaaagcgtatcaggcacaaataaggctttacggagtagtttaggatctgtgagcaccacattttcattctgcaaatacatagttagcaaagtatgggattcgatataacctaagattttgtcgaggccattgtcacaaatcacaattttagaatgagaatcacgagaaagcgtatccatcacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaacccacacaagcggtttaaacacatacatactaaaattcataatacccacaacgctcaacgccaccatttcaggataagtaatagcaatacgttttggaataagatcagcaaataaaataaacaaacaagtcactaatataaaagcgattgtagaggcggttggctcaatccaacttccttcaaaagaacgatttaaaatatctgcaatgtaaggacttagtgcactttcgccaattcccccacccaaaatcgccaccatattcaacaaaatttgaaccaccgtaataaaacgaccaggatgctcttgtaatttaagcacttgaagcgcacgcacgtcgcctttatttgcaagagattgcaattttaacttacgagaactcgccagagaaatttcagcagaagaaacaactgcactacttaaaattaaagccacaattgccaaaatagtatgaaataattccataatcattactcaaaaaataaaagaaaacgggtaccgaggttgatattcgtataac

SEQ ID NO: 538 - DNA, 6686 bp, H. influenzae
  misc_feature (6628)..(6628): n = a, c, g, or t
tgttatacgaatatcagcctcggtacccccgtccaaatctttggtaatacgaacgtcgtgattcgtggtcatgccagtgccataacttgaagtagtcataaattcaatttccacaggtaaatttatctgacgaacgatatccgccataaacataaaggaaccacgtaaaagccctacgacaacaaggctatcgatctgtttttcttgataaaattttgtaatttgagcacctaattcagcaatacgcgcatgaacatcattctctgagattaaaacatctacgtggtgttttttcattgtgtttccttatgaaatgataggggataaaatcgtttgctattttacaaaaaaaaggctgaagtttaaaccttcagcctttgtattcctgccctacattagcccacgagtttgttatatcccgcgacaccacgtttttaattagttgtagggtgggctaaagcccagcctataaactgaaaaacttcctttggcgaataaaaaatcaaaaaataaaaaagactgaagtttaaaccttcagcctttttgaaccctaacgaatttactttctactctacctgttggagcaacctgcaatcgcttaacagatgtgtgtatagtaacagatatttattcattgtcaataagaattattctcaatttcaaaaatattcttaatttcctgaaattttcattttatctaacaaaatagaacccgtttgaatgttagaacgatgctctatatcatcggctacagcaaccatatttttcagcatatcttgtagttgccctgcaatggtaatttcagccactggatactgaatttcaccattttccacccaaaaacctgatgcaccacgggaataatcgcctgtaacgatattgacaccttgtcccatcacatctgttactaacaatcccgttcccatttgatgtaaaagtgcggtcaatcctcccgttaaatttggcttaacaagccagttgtgaatgcctccagcatgccctgtacttggcataccaagttttttaccactgtagcttgtcactaaataagtttgtaatatcccgccttcaacaatttcacgatcttgcgtacgaacaccttcactatcaaaaggcgttgaagccaaacgacgtaataaatgtggtctctcactgatattgaaccaatctggtaagacctgtttgcctaaatgatcgagcaagaaactcgattttctatataaactgccaccacttattgcagcggcaaagtgagaaataagaccagttgcaacatcatttaagaaaatgacaggcacttctcgtgtactcaatttttgaggatttaaacgagaaacgactttctttgcacaattttctccgacccaaattggcgattggagtttgtcgaattcacgagaaattgtatattcgtaatcattttctaaggcagcttctacgccaccaataaccgaacaagataaagaataacggcttgataaataactttgcaacataccgtgactattaccatacactttcacgcctgtatgtgaattaaaacttgcgccattactatttataatacgttcatccgcctctaaagccgccttttcagcctgaagtgcaagttctgttgctttatcaacatccacatcagcagcatgataaagctctaaatcaggcgcatcaaaagccattagatctttatcagccaaccctgtgcaatcatcaggcgaggtgtattttgcaatagcaagtgcggcttccactgcatttttaattgcgctttcgcttaaatcggaagtcgaggcattgcctttttgttgccccatataaacagaaatccccaatgcaccatcattagtaaattctacgttttcaatttcttgcaaacgagcagatacagataaaccgctcactttagtgaccgcgacttctgcactcgcgccagctttcgttgctaacgccactgcaaaactgacggcttgacgtaattcttgttcttgtgcttttaaaagtgcggttgaattttcagctgttttcattattttttcctattaaaaattttcaacattttatcttattttcaaagtttatggtaaaatgtgcaccaatttttataaaggataaaaaatggcaaaacgtaagaaaaaagaagttttcgattgggaagatgaagatcaagaagaaattatttgggtgagtaaaagcgaaatcaaacgcgatgcggaagatttaaaacaacttggcgaaaagattgtcaatttaaccaaagctaatcttgccaaaatcccacttgatgaatccttacttgatgccattgaacttgcacagcgtttacaaaaagaagctcgtcgccgtcaattacagtatatcggcaaattatttcgaggaattgatgttgaacctattcgtgaagccttagataaaattgaaaataagcataatcaacaacaagctatgttgcacaaaatcgaaaaagtgtgcgatgaattggtggaaaaaggtgatgtggctttaactgatttactaaatgattatcctgatggcgatcgtcagcaactacgcaatctgattcgttctgcacaaaaagaactggaacaaaataaaccatcaaaagcctatcgagaaatttatcaaatgctcaaggtattaatgttggaagattaaaaacattgaaattttcatccgcactttgtggataagtgattgaaataaaatgaatattcgttggaatgtaattttgggcgttatcgcactttgtgctttggcgtggttttattccttaaatcaggaaaccgcagatttatctgaacttgtgaaaaaaccagatagtcctgattatgtgggttataaaatggaaacaacggttttttcccctgagggtaaaaaacaatatttggctttatccgataaaattgagcattatacagtcaatgaacaaaccctttttaccgcgcctttagtttatttatatcccacaacatcaaatgaaaaggaacaaaatcccaatcaaaatgtagatttttttagcacacaaaactggaaattaagcgcaaatcaagcaagattgacaaaagatcaaatattgtatttagagggtaatgtcgtcgtgcaaagtttaacatcagattctcgtttgcaacgcattgaaacagaatcagcggtcgtcaatttaaaaacacaggatatgacttccgaaacacaggttaaaattaaggggaaaaattttagttctacaggattaaaattagtcggaaatttacgccaacaagtggcgacattaaaggaacaggtaaaaacatattatgaagttagtaagcaataaaattctttttcttgcaacgatggtattagcatcaagttcagcttttgcattgaaagatgacgttaatcagccgataaatatcgtttcggataatcaatccttagatatggaaaaaagtgtagtgacattcacagataatgtagtaattacacagggatctatcatcattaaagcaaataaagttgttatcactcgtcccgctgaaaaatcagggaaaaaagaaactgtagaagcatttggtacgccagtcacattccatcaacagctagataatggcactccaatagatggaaaagcaaataaagttcattatgatcttggcaacgaatttttaacattaactaacaatgccgaattaaagcagcttgatagtaaaattaatggcagtgttattacctatgatgtgaagaaacaacaacttaaagctaatggtaatggaaaatcacgggtaacaacagttcttattccatctcaattacaacaagctaaagggaagtaatctatgtcaattttgactgcagagaatttagctaaaagctacaaaagtcgtaaagttgtttcggatgtcagtttaaccgtaaattctaatgaaattgtcggtttgctcgggccaaacggtgcaggtaaaacaaccacgttctatatggtcgttgggcttgttcgccaagatcaaggcaaaattgttattgatggcgaagacattagtttgctcccaatgcataatcgtgcgcaacgtggcattggttatttaccgcaagaagcctcgatttttcgccgtttgactgtctatgaaaatttgatggcggtattggaaattcgtaaagatttaaccccacaacaacgtcgcgaaaaagcagatgaattaattgaagaatttaacattagtcatattcgagataatttagggcaagccttatcaggcggcgaacgtcgccgtgtagaaatcgcacgtgccttagctgcaaatccaaaatttattctattagacgaaccttttgctggtgtagatcctatttctgtgagcgatattaaaaaaattatcaccgacttacgtaaccgaggattaggtgttttgattaccgatcataatgtccgtgaaacccttgatgtttgcgaacgcgcttatattgttggtgcaggtaaaattatcgcaacaggtacaccggcacaagtgatgaacgatgaacaggttaaacgagtttatcttggcgaacaattcaaattataaaaatgaaaataactgaactattaagctctgagaatattcgtcagggcgttagtttttctagcaaaaaacgattatttgagtctattgcgcattttgtagaagaacaaatccttgcagaacaaggcgaacaagcctgttttgaatgcctttttgaacgtgaaaaactggggaattctggtttaggaaatgggattgcaatgccaaaagcaaaaatccccgtaacagtatcagataaagcaatcgcagtgtttatgcaactcgataatccgattgattacgatgctgttgatagtaaaccagtggacttaatctttgccttactgattccagaaaatcaatgtgaaagctacattccagttttagcatcattaatagaaaaactgactgataaaaatgtgttgaaacaattacgatcagccaaaagtgcggatgaaatttggcaagtttttgaaattaccgatcaatcagaaacgacacttgaagaagtgaaagaataattacagtggggaaatttatggaaattatcattattagtgggcgttctggtgcaggaaaatctgtagccttacgagcattagaagatacaggatattactgtgttgataatattcctttagatttgcttcctcaattgactgatattctgtctcaatctcaatcttcggtcgccattagtctcgatattcgtaatattccaagctccgctaattctcttgagcaaaccctttcaacgttacaaaagcatcatcaaattaaaatcattttcttagaggctgatcgcgctaccctgattcgccgatatagcgattcacgccgtttgcacccgctttcattaaaagatctatctcttgaagctgcaatagatgaagaatatcgctatcttgagccattgattcaacacgcaaatcttattcttgataccacccatctttctacgcatattcttgcagaacgattacgcgaatttttacgcgataatagtgaaaaagaattaaaaattattgttgaatcttttggttttaaatatgggattcctttagatgcggattatgttttcgatgtccgctttttacctaacccccattgggatccaacattacgcccaatgactggattagaagcccctgtcgcagaatttctaaatagtcatacagaagtcaatgaatttatttatctcactcgtcattacattgatacttggttgccaatgttagaaaaaaataaccgtagctatttgacgattgccattggatgtactgggggaaaacatcgctccgtttatattgcccagcagttaggcgaatattttcaagccaaaggaaaaacggtacaaattcaacataaatctttagaacggaacaaaaaaatataaaaagtgcggtcataaaaacatcatttttattgaccgcactttttttacacgctcactggctttacaatctcactaggataacagcctaaaatctttaagtaattactataattttttagttcttccaaagcctgtttcgtatctggatgatggatatttgcttcaatttctagataaaacatttcttcccaaggcttaccgtaaatcggtcgagattccaattttgtcatatttatttgatgctttttaaacaccaataaagcatccactaacgcgccagcttgctgtgaagttgtcattaataataaggtctttgtgggaatctgtgatgaaacttcgcgaggatctttagccaccacaataaaacgtgtaatattgttctcttgattagcaatattagtttttaatacactaagtccatacaattttccaccatcttcattacccaatgctgcaatattaggtttattcaaacttgcgactaattgcattgcgtgtgaactgctttcgcaatattcaatatgcacacgatcaagactatgaataaattgactacattgttgaatcacttgaggatgactatacaacgtatcaatttgactcaaatctgttttatcattgacaagcacacagtgtttgattggataagccaactctccaactaatgataaatcagtaggctgaagtaaatcataaacttcattaatgcacccgatgntgtattttctaaagcatacaccaaatcagcttcccagtctgaatttttcaatacttgc

SEQ ID NO: 539 - DNA, 4285 bp, H. influenzae
  misc_feature (4280)..(4280): n = a, c, g, or t
cataatagactttaggatcgctcgctaaggcacgtgcaatggctacgcgttgttttgcccgccagaaagattgcttgggtaagcatcacgtttttcacttaaaccaacaagatctaaaagtgcggtaattttttcttggatttttgcttttgactcacttccaatttctaagggtaatgccacgttttcaaatacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagcgcagtcaattttttgttcggtagctcaaaaattttcgtaatattatttagcttaatcatataagccctttttatttattgtttttaaatctgttttggtattctagatgtctagattgctatgtcaatatgtcagattatcttttttagacagattagttatgacttatatttgctaattgcttggattaaatagataattttcgtcaatttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagggggatnccata

SEQ ID NO: 540 - DNA, 9341 bp, H. influenzae
gccagattgctgcctgcggtcgactctaggagaccccttttataaaagtgcggtcaaaatacaataattttccaattattattattttttccaatagcttggaataaacagcacgattaatgaaaacatttctaaacgtccacagatcatagcaaaactaaagactaatttagcactttctggaacaccaataaaactttcgtgaataaaaccaagtcccggtcctgcattcgttaatgtggcgaatacggctcccatcgcatcaaaagtattcattccacaaagaataacagcaaaaacacacccccaataaaccagtataaaaataatgaaaaatgcccaaatactttctatcattcttggtgctagacgatttttacctattcgaattggttgtactaaatttggatggattaaactatgcagttctcgatcgatttgtttccacaatataagtgtccgtatcgcttttaatcccccagttgttgaaccaccacaaccaccaattaccgcagaaattaccagtaaaagcccaataaaaggcggaagattatcaatatcaaaaatcgtataaccagcagtcattgacattgatgttaattgtaatgcaccttttgttactgcctcgtttatatctgaaactaaaccataaccatataaagatagagatacaataccaataaaaataatttgcatcgttagaaaaaaacgaaattcgggatctttccaataatttcgccaaatatttcttttacctagtgcaagaaaagcggaaatatgtaaactaaaattaacaccaccaatcagcataaaaattgttgtaacccaataaatggaagcttgattaaaatagccaatacttgcatcgtgcgttgaaaatccgccatttgaaattgttgaaaaactatgcccaatggcatcaaaaagattcattcctgatagccaatatgcaatggcacaaagaacagttaatgaagcataaataatccatagcgctttcgccacttctgaaattttaggcaaagatttttgatctttaagaggcctgaagattctgctcgatataattgtgtcccaccaattcccaacagcggaattatcgccacagccaatacgataatccccataccacctaaccattgtaaaaactgacgataaaacaaaatagatttaggtaaattatccagccccgtcattaccgttgcaccagtagtagttaagccagaaaatgcttcaaatacggctgaagcaatagttaaatgtggtgaatcgaacaataaaagaggcaatgttgccaagcttcctaaaactaaccaaaaagccacaacaatcaaaaaaccatcacgggatcgtaattcttgtttatggtgatggcatggccaccaaagcaatgtgcccgctgtcaagctcaacataaaagcctgcataaatgccttgccgcccccatcaccataaatcagagcaacaaatgcaggaactagcatcgtacctgaaaaacacatcacaagaataccaataattcggataatcgataaaatacgcacaactattcgcctatctctaaaagttgaataaccaatctacctgaagacttttccgttaattctgaagaaaacgcctctattgttttttcactaatacctaaaatcaaatgaatatttgcctgaaaaccttgagataaaatctcaacctgatatttttcacaaagttgttgaaccaaccttaactgaccatagtcacaatcaagtttgaaaggggttcgttcaactttaatttcgctttcaatcagctttaacgcttgttgtacgccattgccgtaagcacgaactaatccgcccgttccaagcaaaatgccgccataatagcgaaccaccaccgcactgatttcacctaattgactaccttgcaatgcactcaacattggctttcctgccgttccagcaggttcgccatcatcagaaaaaccaagttgtagagaatctgttggcttgcctgctacggcagcccaacaatgatgccgagcatttggatgttcttgtttaatctttgcccaaaaagctcttgcgtcttctaaaccttcggtgtgctgtaaataagtaataaaacggcttttcttaatttcttcttcaaaaacaaccgcacttttaggaacgaggtattccgccatttcttttttcaaggtaatttcaatgacactagtctatcactgatgactgggatttgtcgaaattttgccgtaagtgcggtatgatatggctctgtttttcaaaagaaaaaagaatatgtctgaaatttccgtcacacaaaccctaaatactttaggattacgttgcccagaacctgtcatgcttgttcgtaaaaatattcgtcatcttaacgatggagaaatacttttgattattgctgacgatcctgcaacaacaagagatattccaagtttctgtcaatttatggatcacacattactgcaaagtgaagtggaaaagcccccgttcaaatattgggtgaaaagaggaaaataaaacatcgacctcattaaagtgcggtcgattttttataatttttaaagattacgtaaggcttcaatacgcttttcgagtggtggatggctcataaagagttcactgcgtttaccattaatcataaaggcatttaaagaaccttcgagattttgtggttcgtgaagttgttgcaaacgttgcagtgccataatcattttttctttgcctactaaacttgcggaaccagcatctgcacgaaattctcggtaacgagagaaccacattgcgataatactcgcaagcacaccaaagagcatttccaataccatagaaaccaagaaataaatacctgaactgcgcgtttcctctccattattgttacgcgaacttgctaccgccgttgcgataacgcgagataagaaaatcacgaaagtattcaatacgccttgcaataacgccatcgtcaccatatcgccattggaaatatgagaaatttcgtgcgctaaaacagcttcagcttcagcctccgtcatgttgtttaataatcccgtactcactgccactaaagaattgcttttcgttgcacctgtagcaaaagcattcacatcgggtgaatgataaatcgccacgtctggcatcggaattcccgctttctgtgcttggcgactaacagtatcaattaaccaacgttcagtttgattacgaggttgagtaatcacttctccatctacagaacgtaatgccatcgttttagacaggaataaggaaattaatgaaccagcaaaaccaaatagcaaagccataattaaaatgccgccagtgctatttcctgcaataccagtcacatttaaaataatccccaataccagcattacagccatattggttgccaagaaaagaagaattcgcatcataatgtgttctctcaaagttagggttaagtatttcctttgtggggaaaattcacaaaaaattcaaggtgtaatgtaaaatttttgttatcagcagataaacaaaaagtgcggtcaaaaacatgcgagtttatgaccgcacttttaagcagggattaccaaacagaaaattattttcttacagcaatcgcttcaatttctaatcccacatcttttggtaaacgcgcaacttctacgcaagaacgagcagggaagttaggatgattattttctttaaagaaacgttcgtattctgcattaaccgcagcaaaatcattaagatctttcacgaaaaccgttgtttttacaatatcggctgcggttaaacctgctttctcgataatcgctttcacgttttctaaagattggcgtgcttgtgcaacgatgtcagctggcacttcgcctgttgcaggattcactggaatttgccctgaggttaaaactagattgccaagatcaaccgcttgaacataagggccaatggctgctggtgctttttcagtatgaataatttgagtcatcattttctccttagttgataaaaaattgggtaatttttaccgcacttttctgtttattaatcaatttcttttagtatgtcatcgggaagtgattctttgctttcgactaatttcccatcgtttactttaaattgtaaattttggtaataagcttctcggaacgtgatatatggatcttgagcttgacgtaacaattctgcattattgagatttttcgcacgggcatccactgcttgcacaccatatttcactaatgcccacggaccaccaacccattgccagaatggatacatataagccgcatcaaccactgcacccgttaattggcgtggtgttgttgcattataaatcggtagcacaatataagtgccagcatctacgccgtagctacctaaagtttccccaaatccacgttgattatctatgcgtaattctttgcttgcgctcgcaaaatcaataaaaccacctagtccaaatacagtgttaatccaaaagcgattaaagtgaacaaatgcttttttcggttcaccttcaattaatcggtttatgaaactgactggctcatcaagattatttgcgatgccagcaagaccagaagaaatcggcttaggcacatagttattccaaccttttgcagcgggttctagcacatagcgatctataacattatagttaaatttccacattgttcgattgaagtcttcaagggaatcattacgctcacttgcttgtttcgtggcgttgtgatttgcacaacctgttagtgcaatggcactcaaaagtgcggtcaaaattacctttgttttcatttttgatccttacataaatatgggattattctacctaatttgtgaaataacaacaaattttgcgtataaaaacactcttttatgctgtttcaacaaacattaaaaacaaaaaaccgcactacaaaagtgcggttatattttaatcatttcttagtgtattttttcaacttgaccaaattcaagctcaactggtgtagcacggccaaagattgatacagacacttttaagcgacctttttcataatccacttcttctactgtaccattaaaatcagcaaatggcccttcagtcacacgaacttcctctcccggatgatattcattacgatgacgaggtttatcagtattttgttcaagacgatttaaaatagtatccgcttcacgtttggaaataggtgcaggtttatctggtgtaccaccgataaaacccatcactcttggcacactttttactaaatgccaagtttcatcattcatttccatttctacaagtacataacctggaaaaaatttacgttcacttttgcgacgtttacctgctacattttccaccacttcttcagttggcactaaaacttcaccaaattgatcttccatttgttgttgttttatgtattcacgtaaagttagagctacacgactttcaaagccagaaaacgcttgtaatacataccaacgtttttttgatactgttgtttcttcagtcattttagaatctcaaatcagttaagaaattaatcactgtcacaataatcgaatctactgcccaaaagaagagagaagcaatcattgttaccccgataacgatcaatgttgtttgacgcgcttcagcacgggttggccatacgactttacgcgcttctgtacgagagtcattaaagaacgcacgtgcttttgttccttgattagtaattgccgctaaaataaatgcaatgactaatgcaatagccataccaataacacgaatcggtaaagaatagatttgttggaaataaatattcccaattgccgcagcagcaaaaaagatcacaactaaaacccaaaggaatgtatttaaacctttagatttgccttcaacgatcacttcttgcgtatttttctttttatcaacattttcggttgccatagaattgaatccgttttaaatggaaatgtaaaaaataatgccataagacgtgcgattgtagcaatttcttttcgccttgcctattgaaaataagcatcaacatagaaaatctgggcgaaacaccgcacttttgcgattaaatctaatattctaattttggcgcaagattatctacaattgtcgattcatcaacgataactttttgtaaattctcaagagacggtagatcatacattgtatctaacaacactgcttctacgatagaacgtaagccacgcgcacccgtttttctttcaagtgcttttttcgccattgcttttaatgcttctggtgtgaaatccaattctactttttccaatccaaataaggcttgatattgtttaattaatgcgttttttggttttgtgagaatttgtatcagcgcatcttcgtctaattcacttaatggggcaatcattggcaagcgtccgataaattctggaattaaaccaaatttcatcaaatcatcaggttcaacttgacggaataattcagaaagagattgttgtttttcatctttttcaactttggcattaaaaccaatactcgtactggtttgagtgcgtttatcaataattttatctaatcctgcaaatgcaccgccgcaaataaagagaattttagacgtatccaattttaccatttcttgttgtggatgtttacgaccgccttgaggtggaatggaagctattgtaccttcaataagttttaataaagcctgttgcaccccctctcctgaaacatctcgagtaattgatgcgccttccgatttacggctaattttatcaatttcatcaatataaataatgcctttctctgctttttcagtatcgtattcacaattttgcaaaagtttctgtaatacattctctacatcttctcccacataaccagcttccgttaatgtggttgcatctgccatcgcaaagggtacatttaaacgacgagctaatgtttgcgcaagtaacgtttttccgctacctgtagggcctataagtaaaatattacttttaccaagctctacatcattgctttcatagttagttcgcaagcgtttataatgattataaactgccacagaaagcacttttttcgcataatcttgaccgataacataatcatctagatgagcgcgaatttcgtgaggtgttggtaatttttcttcattttctaccgcactttcctctaaatttttatcatgactttcttcaagcattgagtgacaaagttcaatacattcattacaaatataaccgtctgtgccagcaattaatctatctacttcgcctttttcctttccgcaaaaagagcagtgcaaatctttatctttgtctgtcattatatacccttaacgtttaaccaagacttcatccaccaaaccatacgcttgtgcttcttcagctgacataaaattatcacggtcagtatctttctcaatacgctcaataccttgtccagtatggaatgctaaacgatcatttaaggtgtgtttaattttcaaaatttcttgtgcgtgaatttgaatatctgatgcttgaccacggaaaccacccaaaggttgatggatcatcactcgcgcattgggtaacgcagctcgtttgccagcggttccgccagcaagtaagaatgcgcccattgaacaagcctgaccaatacaaagagtgcgaatatctggcttaataaattgcattgtgtcgtaaattgccatacctgcggtcacagaaccgcctggagagttaatataaatattaatatctttagttggatcttccgattctaaaaaaagaagctgtgccacaattaaatttgccatacgatcttccacttctccacttaggaaaatcacacgttcttttaataaacgggaataaatgtcgtacgaacgttcgccacgcgaagtctgttcaacgaccataggaattacactcattttcttacctttttcattaaaactgctaattattttatcgtaaataacccacaaataaaaatgcgatcgcttttattaaaaagagcgaccgcacttttattcaatcataataatattacttattatgcttgtggattcataatttcatcgaatgaagaaactttttctgttacttgtgcttttgcaagtactgcatcaacagcttgttcttccaatactacattgcgaatattattcattaactcttcgtttttgctgtaatattccacaacttctgctggctgctcgtaagctgatgcaatatctgcaatcattgctttagcgcgttcttcatcagcttttaattcattagatttaatcacttcagagaataataaacccacttgtacacgacgagttgcttcagcttcaaataattcacgcggtaactgtgcagtttgttgtgcattaccgccaaaacgttgagctgcttgattgcgtaatacattaatttcttcttctactgcagaagctggcacatcaatcggattttgttcaattaaaccattgattacttgttgtttaacacgagaaactaacgcatttttcaattcacgttccatatttttacggatttctgcacgcaaatcagcaacagacttagtattaggaccaaatttagcaacaaattcatctgttaattcaggcaacaccatattttcgatttttttcaaagtgatcgcaaattttgctgctttacctttcaagttttctgcgtggtattccgctgggaaagtcacatcaatatcaaattgctcacctgctttatgaccaacaattccttcttcaaaacctggaatcatacgaccttgacccataaataatacaaagtcagtagctttaccaccttcaaattcttcgccatctacagagccaacaaaatcaatagtgacacgatcatctgcttttacaacatcttgactttcagcccaagtagcttgttgtttacgtaacacatcgatcattttatcaatgtcagcttccgtgatttcaacagttggtttttcaactttgatattttctaaaccttgtaatttaacttctggataaacctcgaaagttgcagtgaaaactaagtctttaccttcttcaaaagtttcaatagcaaaagttggacgacctgcaatattaattttttctgcaataacagcatcaaaaaaatgacgtggtaataaatcgtttaatacatcttgacgaattgacgcaccaaaacgttgttcaatgatatgggcaggaacatgacctttacggaaaccatctacgcgcacattttttgcagcacgtttaattcttcacgaacggctttagagacaatttcagttggaacgggaatcgctacgcggcgttctaaaccttgagttgtttcataattaatgacatttggtacctcaattaatttgcactcgggcaaaatcaaccgaccatt

SEQ ID NO: 541 - DNA, 6363 bp, H. influenzae
gaaattcggctcggtacccctttaagtgcggttttatttttcattctttctagctaaaaattacgctaattttttgatttgtgcagctaatttagatttgtggtttgctgctttattagcgtggattaagcctttagaagccatacggtctacaactttttgcatttcaacgaatgctgattcagctgctgatttttcgcctgctgccacttgagcatatacttttttgatataagtacgcatcatagagcgttggcttgcgttgtgttggcgacgtttttcagattgaaccgcgcgtttttttgctgacttgatattagccaaggtcaaactcctaaaatttctgttgattgatagacaaaataaagggcgtcaatatgccgattttttatacttttgtcaatggaaaatttgtgttgatttcggtgagacacaaccgaaagtaagtatcgttatttttacaagctctttcaatatgggctcacacaaacgatgtgtggcggattttatcagttttttttcacggaatatagcgtaaaaacaaaatttctatacaattaggcaaaaattttagggtagagaagaatattttgagtaaacgacttttaaaatctagcattgttgttagttctatgacgttattatcaagagtgttaggtcttgtacgcgatgtagttatcgctcatctcattggggctggcgctgcggcggatgtttttttatttgctaatcgtatcccaaattttcttcgtcgtttatttgctgagggggctttttcacaggcttttgtccctgttctcgcagaatatcaaaaatctggcgatatgaataaaacccgtgaatttattggaaaagtttctggtacccttgggggattggtgagtattgttacgatccttgcgatggttggatcgcctgtcgttgccgctttatttgggatgggctggtttaccgattggatgaatgatggccctgatgcacataaatttgaacaagcctctcttcttcttaaaataacttttccttatttatggtttgttacttttgtcgcgctttttggagctgtacttaacacgattggaaaattcggcgtgatgtccttttcacccgtgttattaaatatagcgatgattgccaccgcacttttccttgcaccacaaatggataacccagatcttgcactggctatcgggatttttcttggcggattattacagttcttattccaaattccatttatgaaacaagcaggtttactggtgaaaccaaaatgggcttggcgggatgaaggcgtaaccaaaattcgtaaattaatgatccctgcgttatttggtgtatcggtaagtcaaattaatcttttgctggatacagtgattgcgagcttcttaatgacgggctctattagctggctgtattattccgaccgcttactggaatttcctctcggtttatttggcattgcgatttctaccgtaattttaccaacgcttgctcgccaccacgttaatcgtgaaggcgattcagctaaaagtgcggttgattttcgtaatacaatggattggggcgtgcgaatgattttcttacttggcgttcctgctgccattggtattgctgtattggctcaaccgatgttacttacgctctttatgcgtggaaatttcatgctaaatgatgtttatgccgcctcttattctttatgggcgtttaatgcgggtttgcttagctttatgttgattaaaatcctcgccaatggctattacgctcgccaagataccaaaaccccagtaaaaattggcattattgccatggtgagtaatatgggctttaatctattggcgattcctttcagctatgttggtttagctattgcttcagcaatgtccgcaactcttaacgcctatttgctctatcgcggcttagccaaagcggatgtgtaccatttttcacgtaaaagtgcggtcttttttgtcaaagttttattggctgcaatcgcaatgggtgcggcagtttggtattacgtgcctgaaatcaaccaatgggcaaaaatggatttctttatgcgtgtttattggcttgtttggttgattgtcttagccgcaatagtttatggcacaacgttgattttattaggcgttcgcaagcaccatttgctgacaaaaaactaacttctcgctataatgccgaaattctcttcttttcatggataaggacatgcaattaattcgtgggcttcataatgcaaatcgtgttttacaaggttgtgcgctaacgatcggcaactttgatggtgtgcatttagggcatcaaaccgtcctccgccatttgcgccaaaaagctgacgaattaaatttacccatggcggtattgttatttgaatcacagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggcaattttgccatgttgcaagcagctagtaagcgttttggttttattgttgaagataaccgtagtttttgtctagatgcacagcgaattagtagcactgcgattcgcgaagcgttagcgaatgatgatttacaacttgcagaaaatttactcggtaaaccttatcgtattttcgggcgtgtgattcatgggaataaattaggtagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagacgtagaaactgcgaaagcgttttttaacagttaattttaaaatgtaaaaattggaaaataaaatgacagtcgattacaaaaacactcttaacctaccggaaaccagctttccaatgcgcggtgatttagctaagcgcgaacctgatatgttgaaaaattggtacgagaaaaatctttaccaaaaaattcgtaaagcgagtaagggcaaaaaatcttttattctgcacgatggccctccgtatgcgaatggtaacattcatattggtcacgctgtaaacaagattctgaaagatattattattaaatccaaaacggcgttaggttttgattcgccttatatcccgggttgggactgccacggcttgccaattgaattaaaagtagaaggtttagtgggcaaaccaaacgagaaaatttctgcggctgaatttcgtcaaaaatgtcgtgaatatgcctcggaacaagtagaaggtcagaaaaaagactttatccgtttaggtgtgttgggcgattgggataatccatatctcacgatgaatttcgataccgaagcgaatattatccgcactttaggtaaagtgattgaaaatggtcatttgtataaaggctcaaaaccagttcactggtgtttggattgcggttcttctttagcagaagcagaagtggaatatgaagacaaagtttctccgtcaatttacgttcgtttccctgcggaaagtgcggttgaaattgaagctaaattttctgcacaaggtagaggacaaggtaaattatcagccatcatttggactaccacaccttggacgatgccgtctaaccgtgcgattgcggtgaatgcagacttagaatacaacttagtccaacttggcgatgagcgcgtgattttagctgctgaattagttgagtcagtggcaaaagcggtgggcgtagaacaagttgaaattctgggttctgtaaaaggtgctgatcttgaattaagccgtttccatcatccattctatgattttactgtaccagtaattttaggcgatcacgtaaccactgatggcggcacgggtttagtacataccgcacctgatcacggtttagacgactttatcgtgggtaaacaatatgatttaccaatggcgggtcttgtatcgaatgatggtaaatttatttcaacgaccgaattctttgcaggcaaaggcgtatttgaagcaaatccgcttgtgatagaaaaattacaagaagtaggtaacttattaaaagttgagaaaatcaaacacagctatccacactgctggcgtcacaaaacgccaattattttccgtgcaacaccgcaatggtttatcggcatggaaacgcaaggtttacgccaacaagcattaggcgaaatcaaacaagttcgctggattccagattggggtcaagcacgtatcgagaaaatggttgaaaaccgccccagactggtgtatttcacgccaacgtacttggggtgtgccgatgaccttgttcgtgcataaagaaaccgaagaacttcatccgcgtaccttagagctacttgaagaagtggcgaaacgtgtagaaagagcgggtattcaagcgtggtgggatttagacgaaaaagaattattaggggcggatgcagaaacctatcgcaaagtgccagatacccttgacgtatggtttgactcaggatcaacctattcttctgttgttgcaaatcgcctagaatttaatggtcaagatattgatatgtatttagaaggttccgaccaacaccgtggctggtttatgtcttctttaatgctttctactgcaacaaacagcaaagcaccatacaagcaagtattaactcacggtttcactgtggatggtcaaggccgtaagatgtcaaaatctatcggtaacatagtgacgccacaagaagtcatggataaattcggtggtgatattttacgtttatgggttgcttcaacagactatacaggcgaaatgaccgtttctgatgagatcttaaaacgtgcagcggacagctatcgtcgtattcgtaacaccgctcgtttcttattagcaaacttgaatggttttgatccaaaacgtgatttagtcaaaccagaagaaatgattagcctagatcgttgggcggtagcttgtgcattagatgcacaaaatgaaattaaagatgcatacgataactatcaattccacactgtggtacaacgtttaatgcgtttctgttcggtagaaatggggtcattctatttagatattatcaaagatcgtcaatatacaaccaaagcagacagccttgcgcgtcgtagctgtcaaactgcgttatggcatattgctgaagcattagttcgttggatggcaccgatcttatctttcactgccgatgaaatttggcaacacttgccacaaactgaaagtgctcgtgcggaattcgtatttactgaagaattctatcaaggcttatttggtttaggcgaggatgaaaaattagatgatgcttactggcaacaactgattaaagttcgttcagaagtaaaccgtgtattagaaatttctcgtaacaataaagaaataggcggcggtttagaagcagaagtgaccgtttatgctaatgacgaatatcgtgcattgttagcacaattaggtaatgaattacgtttcgtattaattacctcaaaagtagatgtaaaatctttatcggaaaaacctgctgatttagcggacagcgaattagagggtattgcggtaagcgtaacacgttctaacgcagaaaaatgccctcgttgctggcattattctgacgaaattggggtaagcccaggacatccaacactttgtgcacgttgtgtagaaaatgtagtgggcaatggagaagttcgatactttgcataattaaattcattgtaaaacaaaaagtgcgattgatttgctctgtccttaaaagttagactaaataagcaacaattatggacaggttaattcgccgcactttttatagggagcaaacaatggcagaagaaacaatttttagtaaaattatccgtaaagaaattccggcaaatatcgtctatcaagatgaattagtcactgcatttcgtgatatttcccctcaagctaaaacacatattttgattattccaaataaagtcattcccacagtgaatgatgtgacggagcaagatgaagtagcgctaggtcgattatttagcgtagcggctaaactcgctaaagaagaaggcattgcggaagaggttggggtctc

SEQ ID NO: 542 - DNA, 9280 bp, H. influenzae
  misc_feature (835)..(835): n = a, c, g, or t
aggcaacttataccactaaagtgggaatgaagccaaatcttatattaaagaaggtttagcaagttattatcatcttaaatttgatgggcgaaaaacagcaagtggcgatgtttataactcaaaacaatttactgcagcacataaaacattgccaataaattcttatgctttagtgacaaatttacataacaatcgtaaagttatcgtacgtattaatgatcgtgggccttttagtgataaacgtttaattgatctttcacacgctgcggcaaaagaaattggcttaatttcccgcggcatagggcaggtaagaattgaggcgttgcacgttgctaaaaatgggaatttatcaggtgcagccacaaaaacactggctaaacaagcaaaaactcaggaagctgccgatcgtttagtattaaaatctaacacgctttttgataacgcatctaagtcaataaatgctctaaaaggaaccgaattttactgtttgaaaatgcttgaattaacctctcatagccaagcaaataaattaattacgcagcttgcgttagcgaatattcagactgaagtaaatcgctcaggaaataaatatgaaatttatattgggccttttgatgacaaaacaaaaatggcacaagtgagaactaaattacaaaaaatggcaaataataagccattaattgtttatacgtataaaaattaattgtaggaacacactatgttgaaaagaacaacaaaaatcgcatttttatcaagttttgtggcacttagtgctttttcggtatctgcagaggatatgcagtttggcgtaactccaccacaaattacggctcanacgtatgtattgatggattataattcaggtgcaattttgaccgcacttaatccagatcaacgtcaatatccagcatcactgactaaaatgatgacaagttatgtagttggtgtcgcattaaaacaaggcaaaatccataataccgatatggttaccattggtgaaagtgcgtgggggcgtaatttccctgattcatcaaaaatgtttttagatttaaatacacaagtatctgtagcagatttaaatcgaggtgtgattgttgtttctggtaatgatgcgactgttgcattagctgaacatatttctggcaatgtaccgaactttgtagaaacaatgaataaatatgttcaacaatttggtttgaaaaatacaaatttcaccacgccccatggtttagacgatccaaatcaatattcttccgcgcgtgatatggcaattattggtgcgcatattattcgtgatttacctgaagaatataaaatttactccgaaaaagactttacatttaataaaatcaaacaagctaaccgtaatggactattatgggataaaactatcaatgttgatggaatgaagacagggcatactagccaagcaggatataacttagtcgcttcagcgactacatcaaacaatatgcgtttaatttctgtagtaatgggtgtgccaacttacaaaggtcgtgaagtagaaagtaagaaacttttacaatggggttttgctaatttcgaaacatttaaaactttagaggctggtaaagaaatttcagaacaaagggtttattatggcgataaaaattcagtaaaacttggtgctttaatggatcactttattacgatacctaaaggtaaacaaagtgaggttaaagctcgttatgaattagcagataaaaatttacaagcaccattagcaaaaggtcaagtgattggtaaagtggtttatcaactggatggtaaggatattgcaagtgccaatttacaagtgatgaatgatgtgggagaagcgggtatttttggtaaactatgggattggttagtattgactgtgaaagggttattctcataaaaacaagttgaaaattgaccgcactttttgatttattttatttttaggaaagaaaatgacaatagaaaacgattatgcaaaactcaaggaattaatggaatttccagcaaaaatgacttttaaagttgcgggaattaatcgagaagggttagcacaagatcttatacaagtggtgcaaaaatatattaaaggcgattatattccaaaagaaaagcgcagtagtaaaggcacttataattcagtttcaattgatattattgctgaaaactttgatcaggtagaaacactctataaagaactggctaaagttgaaggcgtgaaaatggttatttagtatgaacaattcccttatcgttcgtcagttaggattgcaagattatcaagaaatttggcacaaaatgcaggattttactgatactcgaaatgctgaaacgcaagacgaaatttggttagtacaacattatcctgtttttacccaagggcaagcaggtaaaccagagcatcttttacaacgtagtgaaatccctgtggtgcaatcggatcgtggtgggcaaattacctatcacgcacccggtcagcaagtgatgtatgtgcttattgacattaaacgccataaaaacttaaatgtgcgtcaattagttaccgcacttgaacaaacggtggttaaaactttggctgaatatggcattgaaagctatccaaagcctgatgcgccaggtgtttatgtggatggaaaaaagatttgttctcttggattacgtattcgtcgtggttgctcttttcacgggttggcattgaatattaatatggatcttaatcctttccattatattaatccttgtgggtatgcagggcttgaaatgtgtcagttagcggattttgttaatcaagatgaagctgattgcgataatgtttcagcaaaattaattaaacacttcgccgatcttttaggctataatataacaactttataacattttataaaaactaaatgcccaatttgggcatttttatttaggaaaatactatgtctacgcctttcaaaatggaacgcggtgtaaaatatcgcgatgcggcaaaaacctcaattattcccgtaaaaaatatcgatcctaatcaagagttattaaaaaaaccagaatggatgaaaattaaacttccagcaagttcagctaaaattgaaagcattaaaaatggaatgcgccgtcacggattacattctgtttgtgaggaagcgtcttgtccaaatttacacgaatgttttaatcatggcacagccacttttatgattttaggtgcaatttgtacgcgccgttgcccattctgtgatgtggctcacggtaaaccattaccgcctgatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaataatttaaaattctgctaaattaaaccgcactttttgcttgcaacaaaagtgcggtttatttttacaactcagaataaccgccaatattgcctataaattattcaatgtataatgcagtgttaagataatattagattataaagttgggaaaaatatgagcttatcttgtatcgtaatttgctcatcgcttataatagctctatactactaacttggtagtgatgttatgttttcttcttttttggagagtcgatgcaatttgagcgaatttctactgaacaaaaaaaactttccctcattcagacatttttacatcaaaatgcgcttaaattagatgaacaaatcgagtattttgttgttggctataatgataacgaacaaatcgttgtctgtggcggtttagcaggcaatatcataaaatgtgttgcgattgatgagtctttgcgtggtagcggtgttgccttgcaattaattactgaattggttgatttagcttacacgctaaaacgcccacacctttttatttatacaaaacccgaatatgcaacgttgttcaaatcttgtggtttttatatcatctctgatgccaatccttatgtagtattgttagaaaatagtgctacgcgtttacaaaaacaatgctcattatgggagaaaatgcgtgtggatggtaatcgaattggctcgattgtaatgaacgcgaatccatttaccttaggtcatcgttatttaattgagcaagcattacaacaatgtgatcatctgcatttatttattgtcggtgaagacgcatcgcaattttcttacactgaacgatttgaaatgattcaacaaggtattttcgatttatccaatatcactcttcattctggctctgactatattatttctcgtgcaacatttccaaattatttcctaaaagatcaattaattacagatgaaagttattttgagattgatctgaagttattccgtttacatattgctcaagctttgggaataacacatcgctttgttggtactgagctaaattgtcccatcactgccgaatataatcgccaaatgcattattggttaatggatgccgaaatgaatgcaccaaaaataaatgttatcgagatacctagaaaaacagcaagcaaccacattatttctgcttctacagtacgaaagcatttggctgaaaaaaattgggctcaactcgcagagtttgtgcctatgactacgttaaattatttacaaaagtgcggtcgtttttaaatacatttttattcatcaatatacggaaggaaaatctatgaaaataacaaaagtagccgttgcagggacactggaatccagtgatgttcaagtacgggttcaaccttttgattcactcgatattgaaatcaatagctcagtagcaaaacaatttggtgaacaaattgaagcgacagttcgtgaagtattagcaaaactaggcattacagcagcacaagtcattgtagaagacaaaggggcgttagattgcgtgttacaagctcgagtaaaagctgctgcaatgcgtgcaactgatgaaacgattaactgggaggctgtgctatgaaattaagaagaagtatgttatttgtgccgggctcaaatgccgccatgttgagtaatagctttatttataaaccagattccattatgtttgacttagaagatgcggttgcgctcaaagaaaaagattctgctcgtttattagtcgctcatgcacttcaacatccgctttataaagaaattgagaccgtagttcgtgttaatccgctagattctgaatttggtttattggatttgaattcggtagtgcgtgcgggtgtggatgtggtacgtatgccaaaaactgaaagcgcgcaagatgtgttggatatggatcacgccattactgagattgagaaagcctgcggtcgagaagcaggttcgactaaaatgctagcagccatcgaatcgccattaggtatcactcaagccaaccaaatcgctttcgcttctaaacgtttaattggtatcgcattgggtgcagaggattacgtacgtaacttaaaaaccgagcgttcaccagaggggattgaactgctttttgctcgttgttctattttacaagcggcacgtgcggctggcattcaggcttttgataccgtatattctaacgcgaacaatgaagaaggcttcttaaaagaggctgcgttaattaaacagcttggttttgacggtaaatccttaatcaacccacgccaaattgaattgttacacaacttatttgcaccgacacaaaaagacgtggagcaggcaaaacgcattattgaagcggcagcagaagctgaacgacaaggggctggtgttgtttcgttaaacggtaaaatgattgacgcaccgattattgatcgcgcaaaacttgtattagaacgtgcgaaatcaggtattcgtgaagagtaaagggagataaaaagatgacaacaagagaacaacgtattgaaaaatatcacgctgatcgctcagtctatcaggcggtgcctaaatctgaatccctttctcgtacagcgaaagatcgcaaactttgtacctctctagaagaagcgattaaacgctctggcttaaaagatggtatgactgtttcatttcatcatgcttttcggggcggagattttgtggtgaatatggtgatgaataaaattgccgaaatgggtttcaaaaatctgacccttgcatcttcatctttaattgatagccacttcccgattgtcgaatatatcaaaaatggcgtggtcaccaaaatctattcttctggtttacgcggtgaacttgcagagcaaatctctcgtggtttattgaatgaacctgtaaatattcattctcatggtggacgtgttcacttagtaaaatctggcgaattaaaaattgacgttgcttttttaggcgtgccttgctgtgacacattcggtaatgccaatggatttactggaaaaagtaaatgcggctctctaggctatgcgcgtgtcgatgctgaatatgctgaccaagttgtgttgctcacagaggaatttgttgaatacccgcactacccaatcagcatagctcaagatcaagtagatttaatcgtgcaagttgaagcagtcggtgacccgaaaaaaattggtggtggtgcaacccgaatgactaccaatccacgcgaattactcattgcgcgtaaatgtgcagaagtaatttttgccagtggttattttaaagatggcttctcattacaaactggttctgggggggcagcattagctgttacacgctttctagaagaaaaaatgcgtcgtgaaaatatcactgcagatttcgcacttggcggaattactgcaagtatggtggcattacatgagactggtcttattaaaaaattattagatgtacaaagctttgattctgttgcagctgaatcacttgcccgtaacccaaatcatattgaagtctccgctaaccaatatgcgaattacagttccaaaggcgcatctgttgaacgtttagatatggtgattctttctgctttagaaatcgacactaaatttaacgtgaatgtattgactggctctgacggtgtgattcgcggtgcatctggtggtcattgtgataccgcagcttctgcacaagtagcaatcattgtggcaccattagttcgtggtcgtattccaaccgtggtggaaaacgtgattacctgtgtaacacctggtgaaaacgtcgatattctcgttaccgatcatggtgtagcagtaaatcctaaacgtccagatttgattgaagctttaagcaaaacagacattccattgtttactattgaacaactttgtgaacgtgcttacagcattactggtaaaccaaaagaaattgagtttactaataaacctgtggctgttgttcgttatcgtgatggttcggtgattgatacggtgtatcaagttaaagactagaatcagcattacaagcgatctactttcaatagccaaaattaactcttgtcttcccatgattatcaggaaagaaacccaaagagttgaaagggactcaattagctctttcagctttcgccaacaccctataaatggaaagcgttaagaaaatttatttttatacaaaagagcggtcaaattttgcagcatttttttacgacattctctacaaagggttcagaaatttcacttgaagcattacttaatgctcgagaggaacgtgcaattttacaacaacagcttataacacaatatggacaaaccttactttgcatcactttaactgctgtgggtggagtaaaaaaaaatgctttgttggattatgtttttagaaaagctctagaaaatctgaccgcactttttactcagttaaacattacagcagtaaaagaaataatccgtccgttagaaacggggcatgaagcctattttgtattaccgatagatgctcgtacgctaaaagtgctgatgattgaattggaagaaagcattcctcttgctcgtttgtgggatttagatgtgtttaatgctaaaggcaatctactgagtcgtacagattttgatctttctccaagaacttgtttagtgtgcggagaaaatgcaaaaatctgtgcgagaacccgcaagcacgagattgatgagattgtagataaaattcaatctctcgcacagaagcatgatttcgcagaacatattggtgaacaagtttatctggcattaatacaagaggctcgcttatcgccaaaacctggtttagtggatgccatcaataacggttcgcacaaagatatgaacctacatacttttgagcaaagtgcgattagtttaaaacctttttttacgcagtttgttctcaaaggcatgatgaccgcgcatttgtctgaaaatcaaattctcgctgaaattcgtcctttaggtttattagcagaaaaagcaatgtttaaagttactgatggcgtaaacacccacaaaggtgctattttttcttttggtttagtgtgtacggcaattggacgattattggcacaaaaaagtttggttcaaagtgcggtagattttgatgttaaattaatctgctcacttgttgcacaatttactcaaggtttaacggatgaactgaaaaattatcctgaacacttgcctagtacggctggagtgcgtttattccaaaaatatggcttaacaggtgtccgtggcgaagcagaaaatggttttaatctcattcaaacgttgttgccacaatttgatgagtaccatcagttagaatgggaacatcgtttactgattttgttgttgaatttaatggcaattaactccgacactaacgtggttctcgagtggttagcgggatactttctagggacgagccgaatcgaaca

SEQ ID NO: 543 - DNA, 6980 bp, H. influenzae
  misc_feature (6969)..(6969): n = a, c, g, or t
ccagcggtaatatttaaaaaacccgtaccaagcgtaatatttttatgaacgtcaacccatccgccggagttaatggttaaatttccgccttcagaagtaatatctccatcaatctgaacgcctccgtccccctgaccttcactatggagaattaagtgggatctacttccgatactgattgagctattaacggtaagttttctctttgccgttatgttcatcactttggcattttgcagaaaatttgaaatggtttcattggtcagtattgttttgtcggcgttttttttagggctgttttcagtaccgtcaccgattggaaattctgaactaatgtcagtgtcagcgcgagaaaggctaggagcttcaattgttacattatcagggtccagtagccactcttttgttttaacaattgcattgctgtcaatggataagtaatgccccgacgtctccacaaagccaccagttttagcgatatcgctaccttgagcattaatattgccgtcaattaacgcaatatcgccccatacaatagcgcgcccgcctttttctttacctgatacattaattgttgagcctttttctaaagaggttttctttgctaattgaatgccgtttttaccttcgccgcgctcgtcgccgccaagataggtctctccccctcctttacctgaaggtcgataactgcacccgtttttaatgtaactttatcgcctgtaatcatcaacttaccacctttggcttgctgattttgagcggaaatcacaccgctaatttctgcttcaccctctttggcggaaagaataatgttgccgcttttatctttgcttacagaatcggcagaaagtttacctttattgcgaatagtggcggcgcggacattgatgttaccacctttggcaaaaatatcgcccagattgattgcttcattttcaggggcagcaatgctgtaagtaatgggttgggtttattatgtcgctgatggttattttttgccctgcaagtaaagaaatgctaccgccatttacgctaattacaccctcattttttactttgccgccaataaggtttacgctaccgtctttaccaacggtaattaaaccgtgattcacgatttcagcgagtgctttatccttggtttgttcaagggtgaaattacgcgccttgatgttttcgttagaaatgtctagcgtagaagcagtaaagccattagtgttaataattgcttctttacctattgtgataccatttgggttgattaaaaagacctgtccgttagaatctaaaatcccttttaattgggaaatctggtcagatgtaacacggttgaatacggcggagttgttgttttcttgtaaaaactgcaccatttcattttggtcaatgttaaattgtttccaattaatgatagcattgacactattgcggatggtggttttattgccgtctacttgcatggttgctgtaccgtgtacgacgctcattccctgtaaaccgctcgctaaaacagattgcggaatggatgccatgcccaaagatagcaatatagcggaaagtggctttaacgctaagtggcgtacttttgtacgaacaggtttttcactgcctttttctgtggaatggtcacaaccccgtgtcaattcagacacagcaaccaaagcattcaggcgtttgctgaatttgagacgatatatcttgttcatattttctcctaaggttagttgaacaattaaattactttatcatttgcgttcattcatccctctctttattctcgcttccctttccctctctctcacggttcatcatgtgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagattataccattttatatggcggatttatactatttttttaaaatatttgcatatagattgcaaagaagctgttgtaattgttgtttgtcatcacaaaaatcttgatttatttttattgtattgtatattcaaacagttaatttgagtaaggaatattatgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctagggtaggtataccttaggctagtctaagtgctactccgttgaggtggtttgatgttcttcaaagggggatagtataaccataattaactatgggtatataaagtgacctaggtgtaggtataccctaggctaatctcagtgttaccccgttggggtagtttgatgttccccagatggaactactataaacataaattaactgtgggtatacttacccacggcaaatacggagaatgaaatggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataatttataaaaaatcattgcctactgaaaatgaaagtgaaattctgtagaatagttgttccttttttatgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaataatatgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaatnccgtgatagca

SEQ ID NO: 544 - DNA, 6308 bp, H. influenzae
  misc_feature (6305)..(6305): n = a, c, g, or t
ccgcggagggggaggggtaccgggcgggggggcaaaaaaggggggaacgaattggggggtgggaaaaccagaaacaatccgggcaggaccgggaaccttctgtccttcgcccggaaccttggtggtaggatagaaaaaaagtaatcagttggctctcattataatggcctaaaagcggaaaaaaagtgtatgcttatcacaattttggaaaatggtaagaaaatatatcaagatagctctggtaataagtcccagtatgatttaaccaattcaaatggatcaattctcttattctacagatctcagtgcacaaatgcgtgataaatcatctattacggcaacacgaaatccaaatggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttggtaagttattagttccatatcctaagatcaaatcaaatatgctgcaggttattttacatctgtcttagagggaattaaaaaagtctcccaaattcgaatattaatctaagccccatttggggcttttctacacattctttcttagctgtgctataatcccgctaaaattctacccttaaaaacaagagaaattatgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagctaaaacgtagggtgggctttagcccagcaatcatttcaaaaaacggtgggcttaagcccaccctacttcctttttcctatcaattaccataacgtaggacattatgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgcataatgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagcataaaggagagcgataatgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaattaaaattattaagatacgtatgaacttttttcacacacctgtgtctgagattgcagcaagagcttgctgtcttgaatattaaggcgtgttagatattggcataggagaaatatggctgaacagctaacagatcaggctttggtagaaagagtgcagcaaggggataagaaagccttcaatttgttggtttcgcgttatcagaataaaggggatncct

SEQ ID NO: 545 - DNA, 6854 bp, H. influenzae
  misc_feature (6821)..(6821): n = a, c, g, or t
aaaattgctcgcacgaaaccagagggaatgtggaaaagaagggcggataagggggggggaaataaaaatgtggggattggcggacgggactcaggcgaaatacgggccagaaaaactgaagaaacaatttggcactcgtctcgttaaagcaaatgcaacacttcttttccggaccccgaaatgggcaatttccgaagaaggggccttaagatgattagttctgcaacgctggttgacgctgattttggtttcctccccctacgttaacgcagaccacattctcaataaatataatatcaacccagattccgaaggtggctttcatttagcaacagacaactcttctattgctaaattctgtattttttacttgcccgaatccaatatcaatatgagtttagatgcgttatgggcagggaatcaacaactttgtgcttcattgtgttttgcgttgcaatcttcacgttttattggtaccgcatctgcgtttcataaaagagcggtggttttacagtggtttcctaaaaaactcgccgaaattgctgatttaaatgaattgcctgcaaacatccttcatgatgtatatatgcactgcagttatgatttagcaaaaaacaagcacgatgttaagcgtccattaaacgaacttgtccgtaaacatatcctcacgcaaggatggcaagaccgctacctttataccttaggtaaaaaggacggcaaacctgtaatgatggtactgcttgaacattttaattcggggcattcgatttatcgcacacactcaacttcaatgattgcggctcgagaaaaattctatttagttggcttaggctctgagagtgtcgatgaaataggtcgagaagtgtttgacgagttttttgaaatcagtagcaataatataatggagagactgttttttatccgtaaacagtgcgaaactttccagcccgcagttttctatatgccaagcattggcatggatattaccacgatttttgtgagcaacactcggcttgcccctattcaagctgtagccttgggtcatcctgccactacgcactctgaatttattgattatgtcatcgtagaagatgattatgtgggcagtgaagattgtttcagcgaaacccttttacgcttacccaaagatgccctaccttatgtaccatctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatacattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgccttgaactccgtcgttacatcatagaaaacaacggcttacaaaagctttttacaggcgaccctcgtccattgggtaaaatactgcttaagaaaacaaatgaatggaaacgaaagcccttgagtaaaaaataacggtttcttaaagtaaaagtgcggccaattttcaaagcgttttaaaaaactctcaaaaatcaaccgcacttttatatttataacgctcccgcgcgctcacagtttatcagcctcccgccgtaaaactctgccttttatggcagagattttagccaaaactggcagaaattaaaggctaaaatcaccaaattgcaccacaaaatcaccaatacccacaaaaaaacgacttgcatcaaaccccacaccgaatcagcaaaaaaacacgcgatgatttatgttgaagatttacaggtagagaatatgtctaaatcagccaaaggcacagcggaaaaacacggcaaaaacgtgaaatagaaatcaagtttgaaccgagcgatattagaccaatcttggtatgagttcagacggcgattggattacaaattacgtagtatgataaacatccatttaccatcctatcgaaaaatgacccaagtcgcagatatatcgcaaagaatatgatatagtcggtgcgataaatgcatcgaggagtagccaagaaattttggcggtacaaataagcggtcaaattagagcggaacacacccgtagcgcgtgagaagaaaacgattcagcaagattgccactgtcgaagttggttgacaaaacattactaaccacggcatggaatacacaacccaaacatagtttgcatcttccctaaggcatcgtttacattcattagcttatttatgccacagtgtggcaaatttaatttccttggcatcaaaactgcccagtaaataaaagcgataataaatatgtcaaacgccttcgtgtgaacgttcttcattgtattctcgtaagaattggttgaataatatctgttgagcttcaaagctattttgaggttgaagcgccgcttttaagctacagtgcattcgctcgtgtcgtccgttttgctctgggtgtgatagctgaattcgttcaggacgaatacctaagccaatccaccatttagaaagttcactgattcactaatgcttgcgatgcaaaaggtgagccgttatcggtacgaatcgaatacggcagaccaaattactcaaaaagacgttcaaactcagcaataacaggcactgattttgtattcggcaaccccttacagcaaaataaaaagcgactgaaattatccgtaatagttagcgaatagcaaaacttctgattgctgagtaaagctatctaaaagctttttggcacccccagtgaggacgtttaagtttctcactgataagccagtcataaatccattatggcgtggcattagggctatgatgaggtttagccctcaaagccaagctgttggtggcgtttaatccatttatctgccgttggacggctaatattaaactgctgacacagttcagttttagtatagcgttggcttagccacgcttttaagaaaagtacacgctgttgcatcgcatcggtctctatccaaggcatcatcaatctccagtggattaggtattttgatgatgagtttacgggaaaaatgtaaacgatgtcctcgggttagaatgtaaatgatgttatcaggttgtgctcctctttgagaaagagggggtagaaaaattatcttgttctaatcttgctataagctaatgctataacaaaaaatgtggcttgcagaagaataatacaagcacctgttgaggcatcaaaatgatagctcaatattacaccaattaggcttgatataattgaacttataatagcaatccataacattttatcaaaagatttgtgagcgtaagtgcggtaattcttgacgcaattaacattaccaccaccaaaataacgcctaccacttgcatcgtacttacaatggttaaagcaagcagcattaacaaaccatatagcggtcgaatttctgaacttctctgacaattgttcccaaaaatcaacggacaagttaatacctttggcttgcttgatatcacgtaagtcatgctacaactaggatgccttgaatgtgtatatgccgaaatcaatatcgcttttcgcctgcaaacgtgaaaagcagattttcaacgaatttacaagtaataatcacgtctcccttgctaagaagtatgctttatcgttgcaatggatctacaaaatcgtcaaacgtgtgcagaaagaagaaattgccaaacggccgtttaatatattcgcccaatcctaaaaataaacctagtaactgtaaaaaagtctctaggttttctttttatctatgtgtaactccgcttcatttctcctttctcatttcttccccacttcccccaaattcttctcattgatgttggattatgcgtgagagttatgttggatggctttatctacaaacaaatttttatttattgtgattaaaatattgcgacttttaaataaaaaaataatccgaaaaacataaacagatttcatcggataatattgataattttaaataacaaagccagattaaaatgtgaatatttactaatctaaattagcaataattgtgaaatgtcaattaaaataagtaagatgaaaatatgaatattttcatcttactcagcattttcaaaaattttatctttgttcggggtaaattacttcagatgtaacccatttcatccatacttgctctaataatgggattattgacgtactatcttcaaccattgtattaagagcagacaaaacattttctaatgaatttggttgttcttgtagataacttaacaaccagtaatctaactctgaaaggatttgttgctgaatcctaaaatcactatcacgccatataataacttgaattggcgtatcatcaaattgtttaaagtcacttgataaaaaatcaacttcataactttttaaataagctgcaccagataattgcattacgctatgtctattccactcaaatttttcaggcactttggctaaagaaacttctgcgagtaattgtgtattttcaaaatccatcaatgccaatatatttgtatcaaatatctctttttcttgacaaaacaagagaaattctcctgcaatatcttggaaataaggagaatgggcattaccattttgcacaaaattttctttagcatttttccaatactctagctcaatatgcaatggtgcttcaacaaaacaacgatcaataaaaccaaaagcattattacgaactaaacgtgtatataccgctaaacggctttcagcataaccatttaaaggatctgcattacctaaccgaatagcatttgccaatgcttgctgagtttctttcaatgatgacttaggctgcataagacattacctctgtgtgagcgtatttttgctgtaattgtgcaatatgctcaacttcggcgtaaagttctgcaaatggtgggaagttgaaatcacgctccaataatgttggaggaatcgtaggtagtcgttgataggcatattcgagtaaatcccatacagtgccttttacagcttctccgtgtgtatcaattaataattcaggtaaatggcgatatgctccttttactttattaaatgattcatttgctgaattctctacaacttgtgcagcagaatgttcttcatcgtgccctgcaatatgaatgtaattaacacgtttaacatcaacttgatctaaaaagatataaggatcaagcaatccgtgattaacaccattaacataaatattattcacatctaaatgaatgccacaatcagcctcttgtgcgatagcatttaaaaattccacttcattcattgtgctagtaggagaatgcaaataataagaagtattttctaatgaaatttgtaatcctaagaaatcttgcacatcacgtattcgttgtgcaacgtgttttactgcttcttctgtaaatggcataggtaataaatcatataaatgcccttcacattcacaataacttaaatgttcagaaaagaaagacgaattatattgattaattaatgctttcgtattacggagtaattcgcgatcaagtggtgcttgcccacctaaagaaagtgaaagaccgtgtactgctaacggaaatctttctgctgcttgatcaaattgataacgtgccattccacccattttactccaattttctggtgcgacttcaataaattgaatagcgttatttgagggaagttgtaaaaaatcctcagctaaattccgacgataacctagtccagcgccttgtaatttcataattaactcctttttaataaaagctggcataaattgttacgccagcataattattattcttatttagaaccgcatttaccttcgccacatttgccttcagcagctttcggtttgctcgcaccacatttaccctcgccacatttaccttcagcagatttagctttatctgcaccgcatttgccttcaccacacttaccttctgcggctttcgttttgacacatttatcgcctacacaaggtgttgctgtattatcagtattgcttgactttgattcagcctgtactgctgtcgctactgccatcgttaatgcacttgctaatgctgttaatgttgctaattttttcatttgaataatctcctagagtttgaattttgaataaataattagagaaatttcaaccagcttttagttggataaaccttcttaataagcgtgtctaaagagagtttccccgctccctgtgtaattaagattaataaagtcaccacataaattaatggtaatttataaccattatcacatacgttataacctgaatcggcgtgaatgctataccacgcgacagagattaaaatcgttaaacttaatgcactaaaacgtgttagcactccaaatatcagcaaaaatgggaaaattaattctgatcccattgcaacgtgccaattaatatcagctggaatatgattaaatggaaaaggaaaacgatcttgtatttcagcgaaccaattttgtccatccatttttctaatctgctcagtaaaactcccacgcaagaaaaaagggagtcccntagaagacaaccggcaggtcaggcaagtaaggc

SEQ ID NO: 546 - DNA, 7814 bp, H. influenzae
atataatgacgcaacgcacaatttacgccaaaccaatcttccgtttgcaagaaaaagtagtgcctcgaccttttgcacttcctatcactcgttcttgtttttgccaaaattccgcttggaaaaactcggttgcttgctcaaaagtgcggtcaaaattaaagataaaatattggttatcttgttggaattggtgcattagaacgttgttatgaatagaaaatggggtcattctactttaaaataggcacaaattaaatgataaaggaacgtcaatgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattttgaacaaataatctgtatctcaaaacttagatggttttaatatagccaacttgaaagttgtttttggaaagtaagaactttagttttttttaagttaaaaatcaataacttgttgtcaaaataattatatttagtcataaaaatctataccttaatctcttgcttatttagtccaatttttgcaggtacagattgaaatccaaaattagtttgaattttacgcaattaaatgcaaatgattataaataaacctattgattattataatcatcattattatcatcgccattctcctatttttaattattacaataaggaaaacagatgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaaatttactttggaaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaaggaggtatgctatgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcattaacacggtggaagagggtaccgaggctgatattcgtatacca

SEQ ID NO: 547 - DNA, 10509 bp, H. influenzae
  misc_feature (5462)..(5462): n = a, c, g, or t
attaatacaaaccatgaagcccccgtggggataaaatccgctagccttggttaccagagaagatctttgtagccttaaaaaaattcatttttttggatgaaataatgattttgcggattagatcgaaaaaataagtttgagtggttggatatttccagaatatgtttttcttgcgtaaacttaatagccccttatttttcaaaaaccccaaagaaattttcccgcactttgggtacttttctttgctagttcttttgctttggctacctcagatttaaggcttctttcatacctataataatcaacccatagagggttgggtaatgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatattgttccaagtgcggttgattttcacgacatttttctgtcgctttccaacaacgaggattaaatgcacagccttttggcggattaattgggcttggcaattcgcctgtcagcttaatacgctcacggcgcaagtttggcgacaaacgtggtgtcgctgaaagtaacgctttggtataaggatgctgaggattagagaaaatttgttctgtcgtccctttttcaatacaacgacctagatacattaccatcacttcatcagcgatatgttctaccacagaaagatcgtgtgaaatgaacacgtaagacaatcctagttcatcttgtaaatccatcattaaattcagtacttgtgcacgcacggaaacatccaatgcagaaacaggctcatcggcaacaacgacatcgggatctaacattaaaccacgagcgatggcaatacgttggcgttgtccgcctgagaacatgtggggataacgatcataaaattcagcgcgcaagcccactttttccatcatcgataaaactttttctcgccgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaacctgattcacccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttatgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaagggtgttttggctcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttcttgccttttttgtgccgccttcgtgagttttcaacgcttccataatttggaaacccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacccgaacctgattctcccacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgagcttcggaaagcattgtgccaagttctggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgacaacaatcgtcaaaagtaagtttggaattgcgagcataatatcaattaggcgaatgataattgtatctagcacgccgccataataaccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgattttgttctgttggatcaaaaggtgcaatataaggtgcgagaatgctgattaaggcaacaatcaaaataaaaattaaaccaattagcgcaccacgattttgtttaaagtaaaaccaaaattcttgtaagggtgtttttggcgcaaaagttaaaggcgtgtcagacataatttctcctacaattaatgacggatacgcggattgaccacgccgtaaagtaaatcgacggttaaatttaccacaataataatcgtcgcaataatcagtacagaaccttgcaacacaggataatcacgggcttgaatggcatcaataatccattttccaatccccggccaagagaaaatagtttctgtgagaactgcaccagaaagcaattgacctacaattaacccgaccacagtgacaacaggaattaacgcattacgcaatgcgtgaacaataacaattcgagtatagcttaaaccttttgcttttgccgtgcgaatgtaatcttcgcctaatacttccaacatcgcagatcgtgtcatacgcgtaataatggcgagaggaactgtgcctaggactattgcaggaagaattaaggatttcaccgcattttcgaaggcacctggcataccagaaagccagctgtcaataagcataaatcctgttggtgtatcgatccaaaattcattatctaaacgtccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcaggaaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcagaatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacttttcaaagaaattaatcggtaaaaaatataatactcttgaattctaccgcactttttccaattttgccaaatgcgcaatcaaccatttaatgccttgagcttggaacgctatttgtaaacgtgtgttattttcagatccttccacattaatcactgtgccgaaaccaaatttttcgtgtttaactttttgacccattttccattcattttcgaccgcactggtattcgacaatgaaccgacttttgctaggttcatcgcacgcgtgactgtccctcgtaaacgaatttcttggatacattctctcggtaattctgcgataaaccgtgatggcaaatggcgttcttctttggcatataatcgacggctttccgcataagagatggtcagttttttctgcgcacgagtaataccgacataagctaaacgacgctcttcttctaaacgtccgggttcttcaaaagaacgaaaactggganataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatatcttccgcattatcaggtttgataaattcacgggttgcggtaactaattcttccaaattttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcacgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttccacccaatcctgaatttgtgaggcgacaaattttgcttcgtctaattcattaaaggcagcatagatgcccacaggatcgcctttttcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgactttgcctgtttttccagaaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgtaataaacgatgggcaatgctgtgaaaggtgccaatccacataccaactaattgatgttgtgcgtgtttggcaagggtagattgaatacgatgacgcatttctgctgcggctttattggtaaaggtcaccgccataatgctgccttcagaaatattttcgaccgcaattaaccaagcaatacggtgcgtcaatacacgcgttttgcccgatcctgcaccagctagcactaggtgattaccaagaggagcagctacggctttgcgttgtttatcgttaagcccgtcaagtaattcagaaatatccatcataaactatctttaatctgtttaaatttacagttattatagtctcatctatcttgtgaaacaataagatttgtgagtatatcaaaagtagggtagaacattttaagaataatattaagcgggattctcctatatccttaaactcaacatcaaaaccatatgctttgaaagctatttttatactatctataaacaaatttttaattcgtttacctctcattcctaaaatgcaaggtttctcatttttccaaaaatacccatgatgtaatagtataggaatgttgtttaatgacttaatcaatacttgatttgctaggattcctgtaatgattttataaacatttgcttttccttctacttgcacgccattttacgcatagtcggtgattttgtccgaattaagttttaggttaaaaagttactcaaattcaatgttattcataattaatacaaataagaaagagtgagatatggtacaaaatttcaaaaaatggttagcacaaaggaatgggagaagtgtgctatccaagtttcattatgatcactctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagctggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgattcatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttagacctttattgcgtaaaatacagcttgggcattttccgcatccaccttcgatgccttcatagcaagtgtgagtatgtttttgtacataatctaatacgcctaattcatcagcaagctgccaagtttgggctttagtgagatacattaatggtgttttgatattgaattgataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcctgttcatccattaatgcattatgtgtgatagctttcataacagatgtatcaatcaaggtttgtttaatgccgagatcttgcacaatggcgcgcgccttttctaattcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaataaaaaagtgcggttgatttttaaccgcactttcgtttttctattggtagaaattattctactttcacaatccagccttcaggtgcttcgatatcaccgaattggatgcctgttaattcatcataaagacgacgggtaacagggcctacttcagtttctgaatagaatacgtggaattttccgttgtgttgaatgccgcccactggagtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttagtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcagtcgtgataaagtttgatggagccaaaccaccttgaagtaagcacccacggataccgagtcgatatagtataaca

SEQ ID NO: 548 - DNA, 8538 bp, H. influenzae
  misc_feature (8489)..(8489): n = a, c, g, or t
  misc_feature (8511)..(8511): n = a, c, g, or t
tcccttacccgctttttggccggcagaataagcgatgttaacaatggatcaatttttccccaagttttagaggacaggaaaatatcccgcacccatatagcgagattgccaaaatacccagttgaaaatcattaacaatggtttttataattttcagaaaaactttgcgatatagatcgcaaaaatcaacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaatgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaaaatggcgttgttttttctaggttaaatcatcaaaaggtcgccattgtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaatttgctgattattttagacaagcagaagtaaaaggcgtgttaccgcgcgcagagtttggaaaggtttatgctgaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaattatgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaggaggggatttcagccagagaaatgatgcaaattatcgcaaatacaaaacctaattcaaaagttctcgtcaccattctacgattaggcaaaatcttacaaattccagttgttattgaagaatttnccagtaaattaaaaatagcggncgggtaccgagtccgaattcgatacca

SEQ ID NO: 549 - DNA, 9048 bp, H. influenzae
  misc_feature (7917)..(7917): n = a, c, g, or t
gattcgactcgtacccattaaagttgtgcaaatatagacttttcctgaacacgccaaaagccttagctttattttgatagccttgatgcaattgcaacatcatttgttctacttctggtgtaatggacagcaactcgtcgcgtaatacgctttccatttttatactgtcgccatccacatttttgactaactgatgcaaaacaatttgattaacggtaatactcatttttgtcacctttgaaaaatttgccgcaaattataaccgcactttttaagcaagaaaaaagaaattatttaggttctaccaaataatcgggtatcataagccaaattttttttatttttaacattatggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaatatgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaattacgtagtcttgaacgccaaaaatggctaaaaggcactggtatattcttaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaacccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagcgtattaaaattctcgaagttaccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcactttttgtcttttctagagctgttagcatgccacttaatggcccttgaaaatcgggcagttcatcggagaaaacaggaaagccaaattttgcatattctgtttgatttcggttagtgttaattgaaatctgatgaatttgtggttgtaagcgattaataacatgttcaattaaagattgtttacctaaaatctgtaatcctttatcttgcccgcccattctgcgtgctttgccacctgccaaaattaccgcacttattgtaattgtcatattttaatctatcattatttcaagtatcatttgcctattttttacgattaaaacggaaatagcaatgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctatggattancccgcactttctttcatttttgtaaaatcttatagcagaaaattagggcaacaaacagaatttcagcctgttttattgcgcatattatcttaagttttttattcgctttttattatttctgcgatctagatcgcaaactataaagctagttatttaaattacccattgaaaaaagctctttagaggcttggtcaaacttagtgatgatgtggcaaaagttgctattctagcaatgcctgttatactctatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgtagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcacttttatgcaaagcctcgatgcgacgggtaccgagtcgatatcgtataaag

SEQ ID NO: 550 - DNA, 7991 bp, H. influenzae
  misc_feature (982)..(982): n = a, c, g, or t
gtcaactgtacgaataacccatggtttgatacaagagtctacccctctgaacgaaacgtagtaaaccagtacatcaacagccgctcccttcggcagcggatagaacttcacgacctgaggtacatgcaagagcgagatagagggacacgaaacccacagaatcgcgaaggtccacagaacgaccctgacccgcagttggggggccgttcatccgaagccgggtaaataaagatattaaaaacatccgcatggcttgttcacctctcatctaataagatccctgaatatgggggacgccgacagccctcagttaaatacccgctttcttcatagccacattagcctggaggcgcacccactaaacgagagacactgtgcttttccataaactctgacatatcaatgcgcaccatcgcatcttcactatcaaacaagaatttagccaaagttttgcaaagctctgttttacccacacctgttggccctaggaacaagaatgaaccaattgggcgattaggatcggaaagaccagcacgactacgacgaatcgcgtttgctaccgcatcaactgcttcttcttgaccaatcactcgtttatgtagttcatcttccatgcgcaagagtttttctttctcgccttccatcattttggatacaggaatacctgtggctttagaaagcacttctgcgatttcttcatccgtgacacgatagcgtaaaagcgtcatttcttttccttcgctggtttcagcttgctcgagttgcttttcaagagcagggatgcgtccatattgcaactctgacattttcgctaaatcacccgcgcgacgagcttgttctagttcggtttttgcagtatctaattcttgtttaatatgttgagagccagaaagcgttgctttttcagatttccatacttcttcaagttcggcgtattcacgttctttttcagccaattctttctctaacatttctaaacgtntgcgacttgcttcgtcttcttctttttgtaatgcctgttgttccaattttaattggataattcgacgttcaaggcgatcaagcggttcaggtttagaatctatttccatacgaatgctagacgccgcttcatcgatcaaatcaatggctttatccggcaattgacgatcggaaatataacgatgtgaaagcgttgcggcagcgacaatcgcagggtcagtaatatccacgtgatgatgaatttcatagcgttctttcaaaccacgtaagatagcaatggtatcttctacacttggttcgtccacaaatactttttggaaacggcgctcaagtgcggcatctttttcgatatattgacgatattcgtctaacgttgttgcacccacgcaatgtaattcaccgcgcgctaaacttggttttaataagttacccgcatccatcgcaccatcggttttacccgcgccgaccatagtatgaatttcatcaataaagaggatcacgcgaccttcttctttagaaagttcattgagcaccgcttttaaacgttcttcaaattctccgcgatattttgcaccagcaatcaatgcgcccatatctaatgaaagcacacgtttatttttcaaaccttctggcacttcgccgtttacgatacgctgtgccaagccttcgacaatcgccgttttccctacacctggttcaccaattaacacagggttatttttggtacgacgttgtaatacttgaatggctcgacgaatttcttcatcacgcccaattacaggatcaagtttgccactttctgcacgagcggttaaatcaatcgtatatttttcaagagcttgtctgctttcttctgcattttgatcgttcacgttttgtccccctctaatgtgctgaatagcttgcgaaatttgttcttttttcgcaccgcactttttcaaaatatcgctgatcgttcctcgttcttctaaagctgcaagcaaaaacaattcgctcgaaataaatttatcttggttttgctgtgcgaatttatcgcatagattaagtaaattaataagctggcgtgaaagttgtacatctccaccattgccaatcacttgcggcaatttatttagttctgtctttaattcattacgcaataaagccacatttacgccacttgctgtcaaaattggcgcaatagagccgccctgttgatttaaaagtgcggtcaataaatgcacgggttcaataaattgattgtcttttccgatagcaagtgattgtgcttcgcttaacgcttcttggaattttgtcgtaaatttttcaatgttcatacgctttcctcaatttgatttcggctttcgccattcgcataaactaagtaagctcggttgaataaatttcaagagaaaaaatgaaatattttgattttatctatcaataagattttgatgataggttttaatccaccaaaatatcaaacagtggcacatcccaatgctcagtgggaagattttctacttgctgacattggtgcgctaaaccaactggaataaaagacttattttgccaattctgcaacgtgcgatcataaaatccaccgcccataccaaggcgatttccttttttatcaaaagccaccaatggcgtaaataaaatatccagttcatttaatggcaaaacattttgaacatttagctttggctcccaaatgccaaactgattttgtttcattggcgtatcaggtaaatagcgtaaaaccaataaatagtgtttagtaaaaggatgtaaaccaggcaaatacccatttttattttgcatccccagggattggattaaggcttttgttgaaatttcaccatcaaaagaaaaatataatgcaatatttttggcttgtcgttgctcgataagatttaacgcctgttgggtcactgattgtgctgcttgttgctgttgaagtgcggttaaatttgcgcgtatttttcgaatttcagcgcggatttgctggcgtttttgagtattcatagaaatgaaaggagaagataggacccagagtgccgctgcgggcagtagtccttgaacccgacggttcaaggaaatcagttgataccgttttcaggtttcttagcccaatgaacgagtcaaaggttaagcctacacaccaacgataggaaaccaatttataagatttaaagtatcggctcagggacatagcctactgacgaacactccaggtaattcttatgggtttatactagcccaaattcccagtattgactagcatttatttgtcaaatttaacgagttgcttataaaacgacaaaatgactctaatttgatcattaatttaatgcggttcttttgtaacacgaatattttctaatgaatgatctaattgttggatacccgttctcaatacctcttcaattttagccgttttatttttttcttggcttaattcaaaactcaaattgagtgccacaatagagagcacacgatcaagctgaataaggcctgtcttttctttcatttcggaaaccaatatatctaaattacgcgcagcttggcgcagtaattcttcttgttcaatgggtacatttaaacgcaaaacctgacccaaaactaaaatttcgaccaattttaacgacatttgatttccttaaattaaatatttgaatggctgatattatgccatagcaaaaaatattcgtcataaattttacattaaacccgccattcgctcatcaccataaattacgctataatgcccacatttttcagtttaaaacgagatttttatggcccaaattgcaacaaatccgcttgtgctagtggatggttcttcttatttatatcgtgcatttcatgcctttccttctttaactaatgccgcaggtgagccaacaaacgcgatgtacggcgtgttaaatatgttaaaacgcctcatctcacaagtacagcccactcatatagccgttgtttttgatgcaaaagggaaaacatttcgcaatgaaatgtttgaacagtataaatctcatcgcccgccaatgcctgatgatttacgcaaacaaattcagcctttgcacgatatgattcgtgcattgggcattccgcttttagtggtggaagggattgaggcagatgatgtgatcggtactctcgcactacaagcatcaagtttgggtaaaaaagtgctcattagtactggcgataaagatatggcacagttggtggatgacaatattatgctcatcaacacccatgaataatagcctattggatcgtgagggtgtgattgaaaaatacggtattccacctgaactcattattgattatctcgcacttatgggcgatagtgcagataacattcctggcgttgctggcgtgggcgaaaaaaccgcacttggtttactacaaggcataggaagcatggctgaaatttatgccaatcttgaaaaagtagcggaactgccaattcgtggggcgaaaaaactaggtgaaaaattattggctgaaaaacccaatgccgatctttcttatacattagcaaccatcaaaacggatgttgaacttaacgtgacaacagatcaattgttgcttggagaaagccaaaaggatcaactcattgaatattttgctcgctacgaatttaaacgctggcttaatgaagtgatgaatggtgctgactccataacccaaaccactgaacagccagtgaaaatgaaccagtatcaggcgacctcacaagatcaaagtgcggtggaaaatacgcctaaaattcaaatcgatcgtacaaaatatgaaaccttactcactcaagcggatttaacgcgctggattgaaaaactcaatacagcaaaactcattgcagtggatactgaaacagatagcctcgattatatgtctgctaatttagtgggtatatcttttgctcttgaaaatggcgaagccgcttatttaccattgcaattggattatttggatgcgccaaaaacactcgaaaaatcgaccgcacttgcggctatcaaacccattttagaaaatcctgacattcacaaaattggacaaaatattaaatttgatgaaagcatttttgcccgtcatggcattgaattacaaggtgttgaatttgatacgatgttgctttcttatacgctaaatagtacgggtcgtcataatatggacgatttagccaaacgttatttaggtcatgaaactatcgcatttgaaagcatcgctggaaaaggaaaaaatcagcttacgtttaatcaaattccattagaacaagccactgaatacgcagcagaagatgcggatgtgacaatgaaattacaacaagcactgtggttgaaattgcaacaagaaccaacgcttgttgaattgtataaaacaatggaattaccattacttcatgtgctttctcgcatggaacgtacaggcgttttgattgatagtaatgccctctttatgcaatctaacgaaattgccacaagattaaccgcacttgaagaacaagcttacgaattagcaggtcagccatttaatttggcttccaccaaacaattacaagaaattttgttcgataaacttggcctacctattttacaaaaaacgccaaaaggtgcgccatcaacgaatgaagaagtattggaagaattagcctatagccacgaattacccaaaattttggtcgaacatcgtgggttgagcaaacttaaatccacttacacggataaactgcctcaaatggtcaactcacaaacgggacgagtgcatacctcttatcatcaagcggtgacagcgacaggacgtttatcatcaagtgatccaaacttacaaaatatcccgattcggaatgaagaaggtcgtcgtattcgacaagcatttatcgcacgtgaaggttattctattgtcgctgctgactattctcaaattgagctacgcattatggcacatctttctggcgatcaaggcttaattaacgccttctctcaaggcaaggatattcatcgctccacggctgctgaaatcttcggtgtatcattagatgaagtcaccagcgagcaacgtcgcaatgctaaagcgattaatttcggcttaatttatgggatgtccgcgtttggactttcacgccaacttgatatttctcgtcctgatgcaaaaaaatacatggatttatatttccaacgctatccgagtgtacagcaatttatgaccgatatccgtgaaaaagcgaaagcacaaggctatgtggaaacgttatttggtcgccgtttatatttacctgatatcaattctagcaacgcaatgcgtcgtaaaggggcagaacgcgtagcgataaatgcaccgatgcaaggcacagctgcggatattattaaacgagcgatgattaaacttgatgaagtaatctatcacgatcccgacattgaaatgattatgcaagtacacgatgaattagtgtttgaagtgcggtcagaaaaagtcgagtttttccgtgaacaaattaaacaacaaatggaagatgcatcggaattagttgttccgttgatcgtagaagtcggtgtaggtcaaaattgggatgaagcgcattaattggataagtaagaatgaatttagaaagacttaacgaaattgaaaaaccattactccacatcgttaaacacgatgttgtgccagccctaggctgtaccgaacccatttctcttgcactcgcatctgctacagcggcgaaatatttaggcaaaacacctgaacgcattgaagtaaaagtttcgcctaatctgatgaaaaatggattgggcgttgcagtgccaggaacaggtatggttggattgcctattgctgcggcaatgaaggtattgtcgaacacgatcttgatcgaactattgataatctctgcgctattgcatcaaaaagtatgcagcatatcgacagacaggttatcgaaattatagtaagcaagccttgtccttaatgaaaataaagtgcggtaaaaaaataaagaaatttcaatttcactcgaacttatcgtaaacaaaaggggtgagtataaatttacactcaaccctttatcttcattaagagacaatattatttatcactttctttttcatgtggattgcctttgacaccaatatgagaaatttccccattagcatcaatcaaataagcttggccaaaacctcttacaaaacgacctgttccaaatgtaagttcaactaaatcaaaatcagtaaattcacgaattgttttaattccgcctacatcattcatagtttcggctaatttatctaagactttttcaacaattggatcttcacgaggaataaaacgtgcacttgctttataacgtaagcgagtacgcacaataattgacttcgctttgttttcatcttctaaaaacatcacttctacttgatttggattgcgttttaaattctcataatgctctgcaatggcactgatataaatataatattttccatcaaagaaaataattggtgcataagacgccatcggtaagccatctttatctaaagtagaaagcacacagcttttaaactcttgacgaaattcatcaattttagccttaatacgatcgtaatttgctactggtttattttctacacaaagattgatgatagcttgcttaattgaacctgcgtcagcttgttgtggaaattccacacgtaatgttttgccaccattatatttaaaatctaaaccagcaaaatctacattaactaacgtcacatctgtgatttccttttcgccaccaaattttttacaaagggcagccatatcatcttgatgatgatcattcatatgagtgataattcgattgaaatccatttttgttccttatattaacaattaatttttattattctacggaatcatatccgatagaaataatgcagagcattatactcaagttaaagttatttaacatattttttacagaataattcttgataaataaaaagcccttataataaggggtaccgaggctgatattcgtataccag

SEQ ID NO: 551 - DNA, 8341 bp, H. influenzae
ttttgattcccctcaagggacaaaaaaataggtttcatagatctcctaaaatttgcctcacgcaatattctcccaagaatttaatactaaggaatagaacaggcccgggctcatcacggatcttttaagtaatatttagttatatcgccgtaagtgaatttcctctaaggtatggtttttaatggtgttgttatggcgatgtatttaaaatttggtggagctggggggagttgaacccccgtccgaaattactctaccttcagcactacacgtttagtctcgtctttaatttcacttaagcatgcggacagacacgctaaacttaagctagtttgattcaatttagtgcttcgatcctcaaacggtggcttccacacgatctcgttttggtttgactccgcgttatccccgtcttacgagcggaagctggagcgcgaaggctaaatgcaggttattaagctgctaaagcgtattgttcgtcgtttgcgactatttttttgcggtttatttacgaggcctaccgcacctcgacgtgcaccttgggcttcgctaatcccgtcgaatccagaatcagccccaaaattgcgtgttagtctagcaaaaaaagaaagctagggaaagtcgagattgattgaatttttgtatgaaagctagaataaccttaaatattgtctatttattattggcttattaccttattaacaattcatctctaaattgattggagacgatcattgattttttatggacgggaggcttgataatggcgttaattaattggcattatttcacgctttatttttgatgataggagctatagatttgtaaattatggcaaaattaaagatatttacgaattcctaaaaatataacacagcatatatgctataattagctcctaaactttttggaaaatgttatcttattctagtatttatcatcaatgattttataaaatttcttgcatattaaatttttatcactataatgtagcacatatttcggacgcggggtggagcagcttggtagctcgtcgggctcataacccgaaggtcgttggttcaaatccagcccccgcaaccaataataagttcagtaaaagaaccccagttttggggtttttttctataagaaatttagtaactgggcttaggttcttatgaacctaaccctttttttatgcctgagatttaataaactatcttcttactattactaaaatagagggataagtattgtttaggataaggtttcataaggttatgatatagtgcggtgaattacaccctatataggagtagaaattggctacattagaacaaaatttacaagaaatgctacaagatgcggtaaaggatttaggctgtgaattgtggggaattgagtgtcagcgcgtgggtcgttttatgacagttcgtttatttatagataaagaaggtggtgtgacagttgatgattgtgctgatgtaagtcgtcaagtgagcgcaattttagacgtggaagatccaattgcggataaatataatctagaagtgtcgtcacccggtttagatcgtccgctatttaccttgccgcaatttgaacgctatattgggcaagatatcgctgtgcatttgcgaattccagtgatggaacgccgtaaatggcaaggtaagttagagcgtattgaaaaggatatgattactttaatcgttgatgatcaagaacaaattttagtcttcggaaacattcaaaaagcgaatgttgttgcaaaattttaaaaggagaaaaagagaaatgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcacgtgaagatatgttaccacgtgaaaacttccgtccgggagatcgtgttcgtggggtgctttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatccagttggtgcttgcgtaggaatgcgtggtgcgcgtgttcaggcaattacgaatgaacttggtggtgagcgtgtagatatcgtgctttgggatgataatccagcacaatttgtgattaatgcgatggcacctgcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataataaagtgttaaatttatttattaacgcattagaacttgatgaagaatttgcacaaatccttgtagaagaaggattcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaataaggagagcagtaatgactgaagatgttaaggctgatgcgccaaaaaaattaagcattcaacgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcggcaactaagaaagaagctgatgaaaaatcaaaagctgaaaaagcgaaagcagaaaccgctaagccagcaaaaagtgcggtagattctaaagctaaatttgttgatcctgaaaaagagaaacgtaaagcagaagaagctgaacttcgtcgtaaagctgaagaagtggctcgtcaaaaagcagaagaacaagctcgtcgtgcagcagaagaagctaaacgttatgctgaagcagatgattcagacaatgaatcttcttcagaagactattctgattacaatttaagttcaagatatgcacttgaagcagaagatgaagaagatcgtcgtaatgaaaatcgtggtcgaggtaaaaataaagtagcaaaagcaaaaaaaggcggtcgtgacgatgaaaatagcaaaaactcgaaaaacgagcgcgaatctaatcgtaaaaatcaaaaagatgctaagtttggtaaaggtaaaaatggaaaaaaaggcaccgcacttcaacaagcctttactaaaccagttcaagtagtaaaagcagatgttgtgattggcgaaaccattaccgttgcagaacttgcgaacaaaatgtcggtgaaagcgacagaaatcattaaagtgatgatgaaaatgggtgaaatggtcaccatcaaccaagttatcgatcaagaaaccgctcaattagtagcggaagaacttggtcataaagtaattcttcgcaatgaaaatgagcttgaagaagcggtattaggtgatcgcgatgtaaacgcggaaaaagtaacgcgtgcgccagttgtaactattatgggacacgttgatcacggtaaaacttctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggcgcaaaagcaacagatatcgttgttcttgttgttgcggccgatgatggtgtgatgcctcaaactatcgaagcgattcaacacgcaaaagcagcgggtgcacctttagtggttgcagtaaataaaattgataaaccagaagcaaatccagatcgtgttgagcaagaattattacaacatgatgtcatttctgagaaattcggtggtgatgtgcaattcgttccagtatcggcgaagaaaggtactggggttgatgatttattagatgcaatcttacttcaatctgaagtgcttgaattgactgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgcgcgcgcaatgcgtgatgaaaacgggaaagaagtggatgaagcaggtccttcaattccagttgaattattaggtctttcaggtgtgcctgcagcgggtgatgaagcaaccgttgtacgtgatgagaaaaaagcacgtgaagtggcattatatcgtcaaggtaaattccgtgaagtgaaattagctcgtcagcaaaaagctaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgttactactcaatcatctatgaattgttgaatgaaattaaagcagcaatgagcggtatgttagagcctgaatttaaacaagaaattattggtttagctgaagttcgtgatgtattccgtcatccgaaatttggtgcaatcgcaggctgtatggtaactgagggtgtagtgaaacgtaacaacccaatccgtgtattacgtgacaacgtcgttatctttgaaggggaattagaatctcttcgccgtttcaaagatgatgtatctgaagttcgtaacggtatggaatgtggtatcggcgtgaaaaactacaacgatgtaaaagttggcgaccaaatcgaggtgtttgaagtggttgaggttaagcgttcaatctaacctttaacaaaataaagggcggttaaaaatcatagtgtttttaatcgcccttttgttattaaataaaccgcatcaaaattataaaccagttaaatcctcagcaatttcttcagcttgtttaatcacataagttaccgcttcttcctgtttatcaggcgggtatttatatttttgtaaggcacgtcgaacgagtaatctaattcttgcccgcaccgcttctttgtactgccagtcgattgtgaccgattttctaagtgtttccgtgatttctttcgccagtttagaaagcacttcatcacccatcaaatcttttgcactttgattttgagatagagcttcatagaaggctagttcttccttggttaatcctagttttttccctaatgctaaacgttcttggaaatcttggctcattttaaagagttcgtccaaaatctctaccacagtcaaattgtgattgtggtattgattcaatgcttccttcaaacgccgttcaaaatctttttgcaaggttaagtttgtgcctgatttaactttaatttcacttgccaaataacgctccatcgcgctaacccataaatttttagttgggctattttttacagtttgtaaaaattcctcggaaagcaaactgatttgtggttgtggtttttctagcagatcgaataaatcaatcacgccttcagaatacacagtttgattgaccaattttttcaataaaatctgtctttcatttgtgcctgtgcctttttgttcacgtttagttaaaattgcccgtacggcatcataaaaggcgatttcttggttatacggctcaacttcagccaatgtgccgcacagcatatagcctttttttaccaagcctgccgttttcaaaaaggcttttttgcgtggctcggtttcttttttattaaaccaatgctgctcgtgcgctttgccatcaaacgataattgatcaaggcttaaaatatggttggcggcaaaacgaatcgccatcaaaagatcattcggattatctttttctaaggcagcctgaacatcaaaggttttcccctcaactggcgttgcaaacaggctgcggataacttctaaatgctctttcattttaaagaatacatcaatcacgctatcagccagtttgcccttgccttgtgagtttgtatattgccgagtggctttttcgagctcgtcagcaatgcctacataatccacaatcaagccgccattttctcggcttttattgcggaatacacggtttactcgtgcgatggcttgcattaggttatgccctttcattggcttatcaagatacatagtgttacagcacggtgcatcaaagcctgtcagccacatatcacgcacaatcaccactttcagcggatcgttcgggtctttaaaacgacgttctaacgtttgcttttcctgtttactgtaaacgtgtttctgcatttcagacgcatcggaagcagaacctgtcatcacaattttaatcgccccttcgttatattgtccgaatgccattcagggtgcagagcgatgatctgattatacaaatcccacgcaaatctgacggctggaaaccacccatcatcgctttgctgtccaccacttcattgcgttttgcaaaatgttgcacaaaatcgatcgctaaatcatgcaatcgagcttctgagccgagcaatttttctcgcaagcgtaatttcgggttttcttcgccttccagcagttcatcaatttctgcaaataattcatcgtgattagcattctccgctagcttgatttggcgtgcttcatacacaatcggcacggttgcgccatcttccaccgcatcttgcaagtcataaatggacacataacgaccgaacacatcttgcgtgtccttatcttcaaggctaattggcgtacctgtaaaaccaataaacgaggcattaggtaaagcatcacgcaaatggcgagcataacctgtctgaaacttgccgttatgcagcttttgcgtaaagccatattggctgcggtgagcctcatcgctgatcacaataatattgttgcgctcatttaaaatagggaagcggctttcttcctcatttagggcgaatttctgaatcgtagtaaaaaacacgccgccgacttcattttgtgcgagcagttggcgcagttgatcacggtcttctacttgctgcggtgtttgtttgattaaatctttgcctgaagaaaaagtttggaaaagctgaccatctaaatcgttgcggtcggtaaccactacaatggtaggatttttcaattcaggctgtgcaagcagtttgcctgcataaaacagcatcgaaatcgacttacccgaaccctgcgtgtgccacatcacaccgatgcgtttatcgccttgctcgcttgtggcaaaaatcgtggattctactgcttcatttacgccgtaatattgatggtatgccgcgatttttttaatggttttgccaacggaatcccgttcaaacaagacgaaatagcggagggtaccgagtctgatattcgtataccag

SEQ ID NO: 552 - DNA, 9302 bp, H. influenzae
  misc_feature (5833)..(5833): n = a, c, g, or t
ggtaccgaaattcggactcggtacccataccggttaatacagagctgatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataaaaaatacaatttttaatcaaaaagtataaaaaataaaaatcaggcttgacttatttcttttgtactagtttaatagtacaaaattttccaaaaggataaatatgaacattcaaactcaagcctttattgcggtgacagctcaatcaattccctattatgctgataccaccgctatttttaatacactttgccaacctaattcaaattctcttctactcgactctgccgaaatagggagtaaaaatagtttacaaagtcttattttagttaatgctgcggttaaaataacgtgcttaggtcacaacgtcacatttaaagctttaaataagaatggaaaacaagttttaaaagaaattcatccaaaattaaccgcacttggaaaaataagtgcggtcaattttgaagacgaattttctgtacaattttcgccacttgataatcaactcgatgaagataataaattacagtctgctactatttttgatgggttgcgtgttgtttctactctttatcaacatagccaaacgcctatttttttaggcggattatttgcttacgatctcgtcgcaaatttcattccaatggatggcattacattaaaaaatgatggtatcaactgccctgattacagtttctatcttgccgaacacttaattactatcgaccatcaaaatcaacaagcgacacttaaaagtttctgttttgctcaagaagaacaagtcaatattgcgaaaacctcgctttctatcgcacaaaaactaaaaaatattgatcacgttctttctattaaatcggcaagtgatgaagttaaaacaaactttgacgatcctgaatttactggtatcgtaaaagccttaaaacaccatattaatattggagatgttttccaaattgtgccttctcgtcgtttttcccttgcttgccctaatacattagccagttatgctcaactcaaacaaaataatccaagcccttatatgttctatatgaatgatgaagactttattttgtttggtgcatcgccagaaagtgcgctgaaatatgcgccagaaaatcgtcagttagaaatttacccaatcgcaggttcacgccctcgtggttttgatgctcacggcaacattgatcctgaattagatgcacgtttagaactggaacttcgtcttgatcataaagaacaagcggaacatttaatgttagttgatttagcgcgtaacgacattgctcgagtttgccaaaatggtacccgtaaagtggcagaattaatgcaagtggatcgctattctcacattatgcatttagtgtctcgtgtggtgggtaaattacgccctgaattagatgcacttcacgcctatcaagcctgtatgaatatgggcacattaactggtgcaccaaaaattaaagcgatgcagcttatttatcaatttgagcaacaaaaacgccatagttacggtggtgcggtgggttatctcacgtctgatggacattttgatacctgtatcgtgattcgttctgctttcgtacaaaatgggatagcccatgtacaagcaggttgcggtgaagtattggattctgatccacaaatggaagccgatgaaacacgccataaagcagcggctgtcttaaaagcaattcgtcaagttaatacacaagcaaaataaggaagaattattatggctaatattttatttttagataacttcgattccttcacttacaatcttgtggatcaatttcgtgtattaggtcacaacgtcacaatttatcgtaatgactgcgacttagaaaaactggtagaaaccgcactcaatatcaatacacttgataccattcttgcactttctccagggccaggaacaccatcagaagcggggattttactgccattgatcgaacgcttaaaaaatcaagtgccgattattggaatttgtttaggccatcaagcgttgattcaagcctttggtggtaaggttgttcacgctggcgaagtgttgcatggtaaagtttctcgtatatcccatgataacgaagctatgtttaaagatcttgctaatccaatgcctgcggcgcgttatcattctttaatgggacaagatttaccaaaagaatttatcgtcaatgcggaatataatggcattatcatggcaattcgtcatcgtgatttacccatttgcgcattccaatttcaccctgaaagtattttaactgtgcaaggttcgcaattattacaacaatcaattgaatggttgttaaatagataagacagaaaaaagtgcggtgatttttaaccgcactttaaaggagaaaaaatgatcaccgtattcggacttaaatccaaactcgcaccacgtcgtgaacaactcgcggaagtaatttataacagtcttcatctcggattagacattccaaaaggcaagcacgcgattcgctttttgtgtttagaaaaagaagatttttactacccttttgatcgtagcgatgattacaccgtcatcgaaattaacctgatggctggtcgtatggaaggtacaaaaaaacgcttgataaaaatgctatttagcgaattagagtacaaactcggtattcgagctcacgatgtggaaattacgattaaagaacaaccggcacattgctggggtttccgaggaatgacaggcgatgaggcacgcgatttagattacgatatttatgtttaataaaatatagaaaattaacaaatccatatacaaagaaaaacaggaataaactatgcaacacaaccaattattagagcaactttatagcggacattcactttcaacctcagaaagcaccgcactttttaatgcagtcatccaaggtgagctttccaatgaacaaattgctgcaatgcttattgctttaaaagtgcgggaagcaaatactgaggaaattacgggtgcggttgccgcctcattacaaaatgccaaagtatttccacgtccagattatccttttgcggatattgtaggaaacgggtggtgatggacaaaacaccattaatatttccacagccagtgcgattgttgcggcatcaatgggagcaaaagtggcaaaacatggcaatcgtagcgtgtcgagtaaatcaggtgctagcgatgtgcttaccgcacttggcgttaatgtgaacgtcacaccagagcaagctcgacaagcattagatgaaattggtgtctgttttttatttgctcaacaatatcattctggcttccgtcatgttgcaccagtccgtaccgctttaaaaacgcacactatatttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatacccaatatctgaccgcacttttacaaggcaaaggaaaggctgaacatgctaatgcggtggctgcaaatacggcattattattgaaattattcggttacgatgatttaaaacaaaatgtgcaaaatgtattggcgcatcttgcatcaggtaacgcctttaaaacattacagaaattaaccacatattaataaaaagctaatttgatacaccacaataagaagaaaaatgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcctctgctgtatctgttctgacagatgaaaaatacttccaaggcaattttgagttcttgccgttagttcgcggtatcgtgagccaacctgtgctttgcaaagattttatgattagcgaatatcaagtttaccttgctcgctactatcaagcggatgcgattttattaatgctttctgtggtaaatgatgaaacttatcgtgtgctggcagagcttgcacattctcttggcatgggcgtattgacagaaaccagcaatgaagaagaatttgaacgcgcccttgcgcttggtgcgaaaatcattggtgttaataatcgtaacttgcacgatttaactgtggatttaaatcgtgttgttaaactcactgaaaaatacgccgaccgaatccctgctgatgtacgtattattagcgaatcaggcatttacaatcacaagcaaattcatcaattacaaaaggtggcgcatggtttcttaattgggagtagcttaatgggcaaccaagatttgaataatgcggttcgctcggtgatttttggagaaaataaagtatgcggtttaacacgcacgcaagatgtcaaaatcgtttacgaaaacggggcactttacggcggattaatcttcgtagaacattcaaaacgttgtgtgagtttacgccaagcgcaagaattagtaaccgctgcgccacttcgatttgttggtgtttttcagaatcaagaaattgactttatcgtcaaaatagccaaccagttgcagctttatgcggtgcaattacatggtgcagaaactgaagcatttattaccgcacttcgccagcaactaccaaaaaacacgcaaatctggaaagcgatttcggtcaatactgaagcccaaagtacggtcgattttaccgatgatttgaatgtggatcgttatatttttgacagccagacagcgaaccaacaaggcggcacgggtaaaacctttgattggtcattaattcccgaacatcttaagcacaagattattttagctggaggtatctcgccaaataatgtagaacaagccattcaacaaaattgcttaggcttggatcttaattcaggagtagaaagttctgtgggcgtaaaagatcaagaaaaagtacggttagtttttaataatatttattaattttaataacatagaaatcactaaataatccgaaatgcgcaactattgatccagattgtaataatttattctatctaatagtaaaataaatctgtatttcagcttaaatgccaataggagtaaaaatattatgtgtttaggcgttccgggtcaaattgtcaaaattgatacaaattatcttcaacttgccacagtagatgtatgtagcgtacaacgtgaagtaaatatttctgggaaatccagccgatttacttggcaaatgggtggcttgttcatgtgagctttgcaatgagtgttattgatgaagatgaagccaagaaaccccaaaaggctctgatcacaatgaggcaactcgaacacgaagttggagattttttaggattaaatcaaaaataaaaaagtaggcataatgcctacntttttatgttttggtacaatgcctcaatcgccttatactgctcttggattttttctaatccagattggtattccgcttgtttttctcgttctttcgcaatcactgcttcaggtgctttagccacaaaagattcattgctaagtttattctcgatgcgtttaacttcgttttgatatttttcaatctctttggttaaacgggcaagctctgcttctttattgataaagccagccattggcacgagtaattccgcattgccaacgagtttcgctaccgcaagcggtgctgcttcgtttgcagctaacacttgaacgttatctaatttagccattgctttcaaaagagcggtctgtttttcaagaatctttgcattctctgcgcttaaattacggaataacagatctaagcctttacttggtgcgatgttgctttctgcacggatattacgtaccgcaacgatcacttcttttaaccactcaatttcagcttctgcttctagatcaaagccgttctcttccacttgtgggaaaggttgcaacataatgctgtcagccgtaatgccgacaaaacctttcactttttgccaaatttcttcagtaataaatggaataagcggatgtgctaaacgtaataatttttctaacacgtgaaccaaggtttggcttgctgcacggatttgtgctgcgttgccgttggcaaatactggtttagtcaattctaaataccagtcgcagaattggttccaggtacattcataaattgcattagcacaaaggtcaaaacgatattggcttaatgaattacggaacgtttcccactgtgcgattgaattccgattgaatccaacgatccgctaatgagaattcgatctcgccttcacttaaatctaatttttcattcgttaagacgaaacggcttgcattccacaatttgttacagaagttacggtaaccttctaaacgtttcatatcccagttgatatcacgaccatttgaagccaacgccgctaatgtaaaacgcaatgcgtctgtaccgtgagcagcaatgccgtccgcaaattctttacgggttgctttggcaattttctctgctaattgcggctgcatcatgttgccagtgcgtttttcaagtaaatcttcaaggctgataccgtcaatcatatcgattggatcaagtacgttacctttcgatttcgacattttttgaccttgctcatcacggatcaagcctgttacatacacagttttgaatggcacttgaggtttgccattttcatctttcacaaagtgcatcgtaaacataatcatacgcgcaacccagaagaagatgatgtcgaagcctgtgattaacacatccgttggatggaacattttgagctctttggtttgctctggccaacctaaggtagagaacgtccataagcctgatgagaaccatgtgtctaacacatcttcatcttgtttgagttcaaccgcagaatctaagttgtattttgaccgcacttcttcttcgttacgcgcgacataaacgttaccttctgcgtcataccacgctggaatacggtgtccccaccaaagttggcgagaaatacaccaatcttgaatatcacgcatccaagagaagtaaaggttttcatattgtttcggcacgaattggatttcgccgtcttctaccgctttgattgctacatcagcaagcggtttcacgctcacataccattggtcagttagcatcggctcgattggcacaccgccacggtcgccataaggcactttcaaatcgtgtggtttaatttcgtctaataaacccagtgcttcaaaatctgcgacaattttcttacgcgcagcaaaacgttctaagccacggtaatccgcaggaattgtcgcttcatagccagcaagtggtttgccgtcagtaccgataatttccgcttcatcacgaatatttgcgttcagcgtcaatacatttaccattggtaagttatgacgtttacccacttcgtagtcgttgaaatcgtgtgctggggtgattttcacgacacctgtaccgaattcacgatcccacatattcatcggcaataatcggaatttcacgattagccagtggtagaacaacagttttaccaattaaagattgataacgctcatcttcaggatgcactgcaacaagccgtatcgcccaacatggtttctggacgggtggttgccaccactaaataatctttaccatctgccgtttttgcaccgtttgctaacggataacggaaatgccaaagggagcctttgctctctttgttttctacttctaaatcagaaattgcggtgtgaagttttggatcccagtttactaagcgtttgccacggtaaatcaaaccttcttcgtgcaaacgaacaaacacttcttttactgcattcgataaaccatcgtccatggtgaaacgctcacgttcccagtcgattgagttccctaaacggcgcatttgttggctgattgtgccacctgaataagctttccaatcccaaaattttgttgatgaacgcttcacgaccataatcgtggcgagtttgccttcttcagccgcaaattttacgttccaccacattttgggttgcaatacctgcgtggtctgtccccgctgcccataagggtgtatgcccctcccatacggtaaaacgggttaaggtatccataaggtttgtgggaatgcgtgtcccatatgtaaagaaccctgttacgttcggcggcggaattgcaatgcaatagctcggcgcattttcattttcagacggtttaaaataaccgctctcttcccaatgttgataaagggcttgttctaccgcagacggattaaaacggtctgccatttcgaatttttgtgtcatttattttttctctttttgttgcgtgggaatctaatcccactaaagtactaaattatttttctataagatattttatttgttttccaaatttcgttaatgaaatttttaatctatttttatttgttacagtacataaataaattcctgaggcatcttgtaattcatcctcacaaaactcaatatttactaatcctttccgctttagctcttctaaattttggtattcattttccttatcgacttcaaattcaaaattattattttgaataaattctttatctgattcagaaagctctctaatcgttctacattcattaacgtatattctaatcagcttccaacattgccgtgaaactttacctacgataattgagataacaaaataacagattttgagaataacgtcctcaatagtaaaacttttaagttgttctaaaatataagaaaaattcattattaatgtttatttcctttataataattggcaaattttaaaactacccaataagtttaaaattaattatccaagactcatgttcatttggataaattgttttaatcactctttcagcttatccaaccccata

SEQ ID NO: 553 - DNA, 6701 bp, H. influenzae
  misc_feature (80)..(80): n = a, c, g, or t
atgaaatagcggttaatgaatttgtgggttatcttgaatttgcaaaatatttacaaccagattctgcaattgtattaacntgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaatttatcttaatcaattaaaaagtgcggtaaaaaatgaccgcactttattcatttttattcattattaaaaataaggaaaaattatgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcactataatatcttctatcggatttaagaagtgcttgaaaaacaaccgcactttttatataatccgcgcccattatgagccgtttgtggctcatatttttgtgtggtgcaatgaatcttgcactaaaaattatcggggagctatttaatagcgttattacccaattagaggaaaactaaaatggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaataatacgatggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttctttataatttaaagaattgatagattttaaaccgcactttttgaaagtgcggtttttttgtttcataaaatttctatataagttttaaacttgacgagaaagctgcattcatttaaaatttaccgccttaaaattagcaaagatttagattgatttttaatcaatcttgaccttttattgcttaatttaaccgtgtttttgatagaaagcacatccacacaatgacaaattcaccgttatttgtcgttgttttgctcaagttgtcgttctatgtaatttgagttgtcaccccactatagaagtaaggttcagagtgcggtcattttaacggtcattcacgtcacagttagtttgtggctaggtcactgaacagttagcagaggaaaaccaatgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaatccgatgatgtgaaatggtcgtacgaagatgtataaaaatat

SEQ ID NO: 554 - DNA, 9456 bp, H. influenzae
  misc_feature (4075)..(4075): n = a, c, g, or t
  misc_feature (4157)..(4157): n = a, c, g, or t
  misc_feature (4165)..(4165): n = a, c, g, or t
ctttgacaggaaacaggcattaaagttacgctaaatagtcgggaaaagtgagcaacttgcaggtcaattaaaagaagaaggcgataaaacaccagccgatgttttctatactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgcgtagtggtttacgatcacactaaattatctgaaaaaatatggaaaaatcagtgcttgattatgcaacaccaaaatggaaaggcaaaatcggttatgtatcaacttctggcgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaggttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgcttaacaataaagccttatcttcacgataaggcttatttttaaacaatatattcggaaaaaatttgttcaagatgtgatattaaacagtctgcgcctaaaatattttcccctttccacgcctgttgcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgcccttgtggcaaaagatcaggatcaaaaatatccacttccgttccccaatgatgacggctcgcccccggcaatgcagaccaacgtaaaatcgcctgacatttttgccagtcatctaattggttcaaatctaatgcctttcctgcatcatcgtgtactttccgctcgcccttaaatntactgttccaaataagttttggcgtcaaaaatcacgaaaactgctcgcaggctgtaaattaaagccattttttgccgcactntgttgcanagcttgaaatgcttgcatagcttgtgtttgcaaaaaatgatttgatgaatgagttgtgggtaaattgactaaatgctcacgagactttcctgtaagcatttctagggttaatttcattttagctatccaataaattcactaacattttgtgataaatttcaccgcacttgccaagatcttctatactgacacattcattgactttatgaatggttgaatttaacggaccaaattccactacttctgcgcccatcaatgcaataaaacgaccgtctgacgtgccaccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagcgactttttgcttaatgatttcatccgtgacttctgtgcaataacgcaaattaaactgaatatataattcagcaggaattacattattacttcccgtacccgcgtgaatgttagcaatttgtaggcttgttggcgggaaaaattcattgcctttatcccattggtaagtcgttaattcttgcaagaatggggctgctttatggattgggttttcagctaaatgcggataggctacgtgtccttgaatacctttaatatagagatttcctgtaattgagccgcggcgaccatttttgacaacatcgcctaagtttttagcactcgatggctctccaaccatacaataagtaattttttcatcacgcgccattaacgtctcaaccacgcgtatagttccatcttttgcggcagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctagcttttctaaacgttcggcaataatttgctgacagccttcgtcattcgggctaatagacgggcgacgaattaaatcttgtgccaacgaaaccactttttctctcataaaaactcctaagaaaataaccgcactttaagcaaaaacagcctgatattccttttcattaaagccaattaatgccttttcatcttgtaaaataattgggcgtttaattaaagttggattctcagccaacacggaaagtgcggtggttttatcaagggaatttttaacttgctcatccaaattacgccaagttgtactgcgtttattcactaacacatcccagccaaattgagtttccgcttgggttaaaaaattcaaatctaacccatcaacacggtagtcgtgaagtttgtgttcgatattgtgatccgccagccatttcaacgctttcttcactgtatcgcaatttttaatgccgtaaactgtaatcatatttcacctaaaaaagaaaaatcctcaatctaatcagactgaggattttaacccttatactacttcatctcaaatgaattaacctaacaacttattgatacgtttaataaacgcagctggattttccaaagatccgcgctctgctaacatagcttgttcaagcaacagttccacccaatcagcaaattcagtttcatctgcaatatcagccacttttttcactaaatagtgttctggattcagttcaaatgtgtattttacttctggtacaggttgccctgcggctgcaaacaatttcgccatttgggtcgtcatttgatcgttatccgtagaacccgccgctggtgtatccgttaaattgtgagttaaacgcaccgttttcacacgttcgccaagcaagtttttcacacgctcaataaaactaccaaaggctttatcttgttgtttttgtgtttcagattctttatccgctaaatcgcctaaatccaaatctgctttcgtgatactttgtaattgtttaccgtcaaattcagttaaatagcttaacatccattcatcaatacgatcggaaagtaataaaacctcaatgccttttttattgaataattccaagtgtgggctatttttcgctgcaacataactatccgctgtaatgtaatagatagctttttgcccctctttcatacgcaagatgtaatcttctaaagagacagtttgctcactaccatcattatgtgtcgaagcaaaacgcaataactttgcgatagtttctttgttagcaaaatcttctgcagggccttcttttaagactaaaccaaactctttccagaatttaagatatttttctgcatcatcttttgctaatttttctagcatttgtaatgaacgcttagttaatgctttgcgtagtgcagccgtaattttgttatcctgtaaaatttcacgagatacatttaatggcaagtcattactatcgattaaaccacgcataaaacgtagataattcggcataaattgctcagcatcatccataataaatacacgttgaacataaagttttaagccgtgtttatgttcgcgattaaataaatcccaaggtgctttagctggtacataaagcaaactagtatatgcttgatttccttccactttgttatgcgcccaagtcacaggatcaacaaaatcatggcttaagtgtttgtaaaacgctttgtattcctcatcggaaacatcatttttagaacgcgtccaaagggcatcagatttattgattttttcccatttttcgccgcactctttgccctcatcatcgtattctttcgtcagcatttccactggcaagccaatatggtcagaatatttaccaataatttcacgcaaacgccattcatttaaaaattctttttcatcttcacgtaaatgtaaaatcacatctgtaccacgagattttttctcaatatccgccacagaatattcgccttcgcccgcagattcccaaagcacagctttatccgcctcttcgccagccgctctagtttttacagtcactttatctgccacaataaaagcagaataaaaacccacaccaaactgcccaataagctggctattttttgcttgatcttggccaagtgcggttaaaaattcttttgttcctgattttgcaatcgtccccaaatgatcgatgacttgctcacgagtcataccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaagccgcgagtttcttgattttgtgacataattttttccttcataaagataaaaattgaacgtcacagatataagaataaaaagaaagatttcaagggaaatttaagaggaaaagtgcggtaaaaaacacaaggaatttaaaccgcactttaaataaaaaatttcttatttccccttgatcgctataaatttatatatataatgaattctgttttagatactagatagtaatttaatagtaatgaaacttggctagtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaccgcacgctttcttctctataagatcctacaatcataactaataacaattagcttcctttaataaaagaaaaaattgaatgcccattaaaaataagcaacaatacccaaaaaatttcataatattaagtgggaacaaatatggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcattctta

SEQ ID NO: 555 - DNA, 9573 bp, H. influenzae
  misc_feature (9284)..(9284): n = a, c, g, or t
  misc_feature (9406)..(9406): n = a, c, g, or t
  misc_feature (9423)..(9423): n = a, c, g, or t
  misc_feature (9477)..(9477): n = a, c, g, or t
  misc_feature (9491)..(9491): n = a, c, g, or t
catttttatttggggtatcgaatttaatgttagaagatatgggctgtcttggcgtattgatggttcaatagacaaaaaattttaatcataacccagtggatattctattaataatcacttcttgaaaaatattactagccttgcactttttccagtataatctgaccaattttctgacaaattaaaacaagacgatgaataaaaaacacactttaatttcacttgctattttgaccgcactttatagccaacaaagtttggcagatttgcacgaacaatgtttaatgggcgtgccaaaatttagcggtgaagtcgtgacgggtgatgtgaattctctgcctgtatatattgaagcggataacgcagaaattaatcagccaaatgatgcgacctatcaaggtaatgtagatttgaaacaaggccaatcgccatttgttagcacaatccgtgcaggtcaaacaatctggaaaccaatcaacacctttacgcatggcttatgtccgcaatggatttgattataaagataatcagatcaatatgttgggtaaagatgcagagtttaatttagatagtcacgatggtaatttaacaaattcagaatatgaatttgtcggtcgtcaaggacgtggtaaagctgataatataacactgcataataattatcgtgtaatgaagaatgcaacctttacgtcatgtttgcacggcgacaatgcttgggctgtagatgcgtcagaaattcgtcaatacgtgaaagaagaatatgctgaaatgtggcatgctcgctttaaaatacatggtgttcccgtcttttataccccttacttacaattacccattggagatcgtcgtcgttctggtttattgattccaagcgcgggaacatctaaccgagatggtctttggtatgcacaaccaatttattggaatatcgctcctaattatgatcttactttcaccccgaaatatatgtctcgccgtggttggcaagcaaatggggaatttcgctatttaacctccattggcgaaggtaaagtggcaggagaatatttaggtaaggatcgttactctgaatatgctagtgataatcgaaaacgtcatttgttctattggaatcacaattctagctttttacaaaattggcgtctaaatattaattacacccgagtaagcgataaacgttatttcaacgactttgattctatttatggacgcagtaccgatggttatgcgaaccaatatgctcgcatagcttattatcaaccaaattataatttttctctttctgcacatcagttccaaatttttgatgatattgtaaacatcggcccttaccgtgcagtaccacaattagatttcaactatcacaaatatgatttagcgaatggatggttaaatttcaaattacattcacaagcagttcgttttgataatgacagtaaattgatgccaactgcatggcgtttccatgcagaacctagcctaaattctttaatgtcaaataaatacggcagtttgaatattgaaacgaaactttatgcgactcgttacgagcagaaaaaaggttcaggaaaaaatgcagaggacgtgcaaaaaacggtaaatcgagttattccacaatttaaagttgatttacaaagtgtattatcacgcgatataacgttcttaaaagagtatacacaaaccttcgaaccgcacgtgcagtatttatatcgtccttaccgaaatcaaagcaatattggttcaacacttaataatgattatttgggatttggttacgattcagcattagtacagcaagattactattcgctattccgtgatcgccgttatagtggtttagatcgaatttcatcggcaaatcaagttaccttgggtggcacaacgcgtttttatgatattgctggcgaagaacgatttaatttatctgcaggtcaaatttattacttaagtaattctcgtattgatgaaaaccctgcgaataaaacaccaacttcatcatctgcttgggcattagaatctaattggaaaataagtaataaatggtattggcgtggtagctatcaatttgatactcataccaattcaacatcattagcgaatacatcactagaatataatcctgaaaaaaataatttaattcagttaaattatcgatatgtgaaccaagaatatattgaccaaaacttaggtaaatcggctaacgcctatcaacaagatatccaacaagtgggattagttgtaggctgggaaattgccaataattgggctgtagtaggacgctattatcaagatctcgccttacaaaaaccagtagaacaatatctaggcgttcaatataacagttgctgttgggctgcaagtgttggtgtaaaacgcaatgtcacaaaccaccaaaaccaaacacgtaatgaaattgtttatgataatagcattggcataaccttagaattaagggggctaggcagcaatgaccatcaaagcggcattcaagagatgttagaaaaagggaaactaccttatattcgagcatttagtttggattaaacattgttcaatataaacgttagatcaacaaaaagagcggctatttttaaccgctcttttgtcacaatatacaaaataaaatactgattagagattacctaacttttcgtttaaaacactgagcaatttatctttactaatcatttctttttcaccggtacgacgattcttatattcaatttcaccgttgtctaggtttttctcaccgattaccaccatatgcggtataccgataagttccatgtctgcaaacatcacgcctgggcgttctttacgatcatcaaaaatcacatctacgccttgcgattgtaaagtgcggtaaagttcttcagcgtatttttgcacggcttcagatttgtgcatgttcattggcacaatcgccacagtgaatggggcgatttcgtctgatggccagatgataccgcgatcatcatgatgctgttcaatcgctgaagccaccacacgagttacaccaataccgtagcaacccatcgtcatcacaagtggtttaccatcttcgccttgaacggtcgctttcatcgcttcagagtattttttacccagttggaaaatatgccccacttcaataccacgtttgatttgaagcgtgcctttgccatctggactaggatcgccttctactacgttacgtaaatcaaatacttcaggcattgctacatcgcgtacccagttcacattgaaataatgttttccatcaatattcgcaccacaactaaaatcagacattaacgccacagtgcggtcaataattgcaggaatattaagatttaccgcgcctaacgatcccacgcccgcaccaattttcgctttgatttcagtttcgtccgcaaactcaaggggatctgccactaacgggtgtttttgtgctttgatctcgtttaattcatggtcgccgcgaataatcaacgcaacaagcggttgattttcgtctgcacctttcacaatcaaagtttttacggttttctcgattggtaaattgaattgctccaccaactccgcaatagttttcgcatttggtgtatcaactaaacacatttcagcggttggagcttggcgttcgcctatagcaattgcttctgcaagctcaatattcgcggcaaaatccgattccgttgagaacacaacatcatcttccccgcttgaagctaacacttggaattcgtgagaagctgaacccccgattgaacctgtatccgcttgcaccgcacggaaatctaagcctaaacgtctaaaaatgttactgtatacttgatacatcacatcataggttgcttgcaaactttcttgtgtcgtgtggaaagaatacgcatctttcataataaattcacgcgaacgcattacaccaaaacgagggcgcacttcatcacggaatttagtttgaatttggtataaattaagtggaagttgtttgtatgaagaaacttctcggcggactaaatctgtaatcacttcctcgtgagttggcccaagtacaaagttacggtttccacggtcttcaaaacgaagcaattcagggccatattgatcccaacgaccagactcttcccataattccgcaggttgcacaactggcattaatacctcaatggcaccacctttgttcatctcttcgcgaacaactttttccacttttttcaatacgcgaatacccgtcggtaaccagttatataaacctgatgccattgggcgaatcatacctgcacgcaacattaattggtggctcacaacctgagcatcatttggcgtttcttttagggtggaaaataaatattgacttgtacgcattgtttaaccttaaattctaagaactgaaaaaattggcgcaagtataacaaaaagtgcggtcatttttaaccgcacttttaacacttagtcattattttgcgcattcgccaaaattgccttatgttcttgaatcaatgccataaacggctgcccaaaccgctctaatttgatagagcccacgccattaatttgcaacatttcaatattgcttgtcggcatatattgtgccatttcttgcaacgtcgcatcattaaagacaatgtacggcggaatattttctttatcggcaatttgtttgcgtaggaaacgcaagcgtgcaaataaatccttatcgtaatttgcaacaccttgacgttgtggattatgggcaattttactgattgaagaaatacgaggcattgccaattctaacggttcttcgcctttcaaaatcactttcgcactttcagtaagttgcaacgttggatttaattcactaataacctgttgcacaaaacccaaatgaataagctgacgaataacagactgccaatgctctttgcttttatcttttccaatgccatatactgaaagtttatggtgttggcgttcaataattttctgattgtgcatgccacgcaacaccgcaatcacataatgtgcaccaaaacattgtcccactcgataaatagtagacattactttttgcgcatcgactaagccatcatattttttaggaggatcaaggcaaatatcacagttattacatggtgtttgtcgatgctcgccaaaataattgagaagaactaaacggcgacaagtctggctttccgcaaattccccaatagcttctaatttatgctgctcaatctgacgctgtggcgtttctggtttttcgaagagaattttttgtaaccaagcgtaatcagctggttcataaaacaaaaccgcctcggcaggcaaatcatcacgtcctgctcgacctgtttcttgatagtaagattcaatgctacgtggtaaatcaaaatgggcaacaaagcgcacattggatttattaatccccattccaaaagcaatggttgcgactactacttgaacattatcacgctgaaaatcctgttgcacacgttcacgaattgccgtttccattcctgcgtggtaagcagcagcagagacacctttattgcgtaaactttccgcaattcgctcaaccttatttctgctgttgcaataaataatcccactcttacccttttgagccaacacaaaacgtgtcagttgctccataggtttgtatttttcttccaaggtataacgaatatttggtcgatcaaaactaccaatatatttgtgcagatttttcagattaagatgccgcagaatatctttttgagtcgcataatctgccgttgccgtaagtgccataatcggcgcatcagggaaactggcttttaaaccgccaagctgggtatattcagggcgaaagtcatgcccccattgagaaatacaatgtgcttcatcaatcgcaataaagcagactttgctataagaaataagttgaaagaaactgttcgtcatcactttttctggcgacacataaagtagtttaagttgcccagaaataagcttattttgtacttgttgctgctgttctaaagtctgactagaattaagaaaatccgcctcaattccattagcttgcagctgatccacttgatctttcatcaaggaaatcagcggagaaatcactaaagttaaaccatcaaaacaaagtgcgggaatttggtaacaaagcgatttgccattccccgttgccattaccaccaacgcatcttgtccatttaaagcagcattaataacttcttcctgccctttacggaaagattgataaccgaaaaccgatttcaaaacagaaagtgcggtcggtttttctattatttttgatggtaaaggagaatccagcattttagaactgcacgttctcgccatgtgcagcacaggcttcaacgaaacaatcccaaaaacgttgtccgtcattagaaacccagtcgccatttttaaaagcaaaatggaaaccgcctaatttacttgcaatccaaagctcaagcagcggttcttgcttgttaatcactatttgtgtgcgattatcaaaggtgattgtaaatactgaaccttgcgtttcacaatctacatctgcaccttggttttccaattcttcttcaattttttgccaaacttgttcaatattttggtgaaattctgcaatattcataaaatgttcctgtttaaatctgataaaatgtggcaaattataaagcctttctcaagcttgtgaaaggcggatttaccgataagtgagagagagaaaaatgaaaaaactactatcaattttagtgcttagtgcaatttgcattgtgacaacaggatgcggcgtaaaaggttctttatattttcctgaaaaagatcaagctcaacaaactcaataatctattatctaatatcattcccaaaataactaaaacaggcacacaacatgaatttcttccaatataaacataacaaactttatgccgaagatatgccagttcaacaacttgctgaacaattcggtacacctctttatgtatattctcgcgcgacactagaacgtcattggcacgcttttgactcagctttcggtaagcgtcctcacttaatttgctttgccgtgaaatcttgctcaaatattggcgtgttaaatattatggcaaaacttggttcaggtttcgatattgtctcacaaggcgaacttgagcgtgtactggcagcaggtggcgatgcgtcaaaagtagtcttttctggcgttgcgaaatctcgagaagaaattatgcgcgcattagaagttggaatccgttgctttaatgtggaatcagtttctgagctcaagcacattaaccaaatcgcgggagaaatgggtaaaatcgcacctatttctttacgtgtaaatccagatgttgatgctcatacacacccttatatttcaacaggattaaaagaaaataaatttggtgtaagcgtaaatgaagctcgagaggtatataaattagcctcaacgctaccaaacataaaaataacagggatggattgccacataggctcacagctcaccgaattacaaccattcttagatgcaacagatcgattaattgtcctaatggaacaattaaaagaagatggaattacattaaaacatctcgatctgggcggtggtttaggcgtgacttatacggatgaaacaccaccgcatccaagcgattacgcaaatgcgttattagaaaaactaaaaaattatcccgaacttgaaattattcttgaacccggcagagcaatttctgcaaatgcaggaattctagtagcaaaagtacaatacttaaaaagtaatgaaagccgtaatttcgccattaccgatacaggaatgaacgatatgatccgaccagcattgtatgaggcttacatgaacatcgtcgaaattgaccgcactttagaaagagaaaaagccatttatgatgttgtagggcctgtttgcgaaacgtctgatttcttaggcaaacaacgggaactttcaattgctgaaggggattatattgctcaatgttctgctggtgcctatggagcaagtatgtcatcaaactataattcaagagcccgcactgcagaagttttagtagatggcgatcaatcctatctaattcgtcgtcgagaaaccttacaggaactttgggcattagaatcgaccatttaatatttcttatcttaaaaaagagcggtaaaaaattatctatttttctaccgcactttttctatttttatccatcaataaacctacctcaaatagtaagtttgtgatataaatcaaatttttttctattctagattggcatagaattgaattctttataaaatgtcatgctttttaaagtggacttctaaccactaaaggagaaattatgcaagataagctaaaagttttattgattgacgaccatccgttaatgcgtcgtggcattaaacaacttgtagaattagacgataactttgaagtagtggctgacgtaagcagcggcacagaagggatttctgtggcattacaaacatcacctgatgtgatcattttagatctcaacatgaaaggactttctgggttagatacgctcaaaggattacgtgcagaaggcgttgatgcgcgaattttaattttaacagtgtctgatgcaaaaaatgatatttatactctaattgatgcaggtgcagatggttatttgttaaaagatactgaacctgatacattgctagaccaaatcaagcgcatagcacaaggcgaagtcattctgagtgattctattaaaaatttattattagaacgtactcacgaagataatccgttagacagcttaacggatcgtgaaatgggcgtacttcgtcaaattgcaactggcttatcaaacaaacaaattgcagcacaactgtttatttcagaagaaaccgtaaaagtacatatccgtaatttattacgtaaattaaatgttcattctcgtgttgcagcaacggtattattttttgaacaaaatcgttaaaaataatcataaaaaatgcgctaggagagacttagcgcatttttctttaaaattataatatttaaattagctcaatagatttaatatcttctaataaaatatacaattcttgtttaatatttttttcaaactgtgcttctgcactttctcgagctaaatccagacgcattctttctcttttctcaagtagtttacggtcatcatgtgtaggcatatcacgcaccacttcatataaattagccatcgcaggataagatgataaattcttaccaaaaggccttaatagcatagtaagacgaattacgccttcagaaagattacattctccagactgcattgcancgagcataatatcaatgctctcttttaatcgtataaccccgatattcttagctttagcaatcaattccttttgaacttttactgcttaataaacggatgcatatagagtcatccagttacangaaaagtgcgatgacanaaatatcccaatcatagattacctaaattgataaatatccatacgctcgaaggngcgggataatcatnttcgctttcatcttcggctcaatgccaagttctccattactcaaaattcgatctagcatcatcacaaatgggggacctgatc

SEQ ID NO: 556 - DNA, 8875 bp, H. influenzae
gagaccccatacgtttggttgcatgacgagccataggttgatctactgtgccgcctttagtcataatgcctgaagcgactgcttcatattcgcgcgtaattttgcgtttttgtaagtctcgcactaacttagtttgtgctggaatggttttagcaacaaccattagacctgttgtatctttatctaatcgatgcacaattcctgctctcggtacttctgatatcggtggataatgatagagtaacgcattgagtacagttccatttggattgccagcaccggggtgtaccacaagatcttttggtttgttaatcacaataatatcatcatcttcatacacaatattcaatggaatattttctgcttcaaaacgtgtttcatcttccacttcaacaataatctctattctctctcctccaaacactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcacctaaaagttgaataaaatttaaactaattaaggtgcagatttttttattttttatcaactgaaaatgcttcaccatagttcgcacaaataatctgagcagcattataaagcgttgtatcaggtgttaaacttaacgtatgtttcttttgctttttaggtgctgcccgcaaaccctgtccccaaaattcatcatagaaatcagttcgtacttgagttaaatgataatttgcacaattcaagatcttatactgacgaacagaacgtgcataacgtttaggctcaggataaacatacaatcccttatctaaattcaccactgcatcaaaatgtacaatttgtggctcttggttatccacccagatcgattcactatcgatgtaataattcacattctttaccaaacgtatatatccgcttcgtacatcagtcggcggtgccagcttcacatcattttgtttagccttttggatttgagcagaacaggcagtaagtaacccaagtgataatgttaaaataatttttttcattatttactccttatgttagctgacatttattctagaattttacagtgtgcccataaccttctaggattgttttaatatgctctaaggattctttagttggcggtaatacatcttcaagctcataatctaacccaagggttttccatttatgtgcacctaatcgatgataaggaagaagctcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttattgggtaccccaataagattttgatgaacttgatcattaagctcttttaaatcgagtaaaacaagatctgttacatctaataattcatcaataatatgattataatgacgtacaaaaccatttgtatccaagcaagtattaatcccttccgctttacaagctcggaaccaatcgcgtacaaactctgcttgtaacacagcctcgccaccagatgccgtaacaccaccgccagtagcattcataaaatggcgataagtcacgacttctttcattaaatcttcgacactgatttctttccccccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaatatttagtctataaaaaatgagcctgatttaaatcaggctcattatgttcccaccaaagtgcggtcaaaaataaaaatgtttttacattgactctgtgaaagttctagtaattacgtcttgttgttgctctttagttaaagagttaaaacgtactgcgtaaccagatacacggatagtcaattgtggatatttatccggattttccattgcatctaacaacatttcacggtttaacacgttcacatttaagtgttggccaccttcaaccgttgcttcgtggtggaagtaaccatccattaagccagcaaggttgcgacgttgtgcttcggcatctttacctaacgcatttggtacgattgagaaggtataagaaataccatctttcgcgtaagcaaatggaagtttagctacagaagttaatgatgctaccgcacctttttggtcacgtccgtgcattgggttcgcacctggtccgaatggtgcaccagcacgacggccatctggggtgttgcccgttttcttaccataaactacgttagaagtaatggttaatacagattgtgtaggcactgcattgcggtaagttttaagtttttgaattttcttcatgaaacgttcaactaagtcacaagcgatgtcatcaacacggttatcgttattaccatattgtggatattcaccttcaatttcaaagtcgattgctacgttagttgcaacaacattgccatctttatctttgatgtcgccacgaactggtttaacttttgcatatttgattgctgaaagtgagtcagccgcaacagaaagacctgcgataccacaagccatggtacggtatacatcacgatcatgtaatgccattaatgcggcttcgtatgaatatttatcgtgcatatagtggattacgtttaaggcagtcacatattgtttagccaaccaatccataaagctatccatacgagtcattactgtatcgaaatctaatacttcatcagtaattggtgcagttttcgggcctacttgcatacctaatttttcatcaataccgccgttgattgcgtataacaatgttttcgctaagtttgcacgtgcaccgaagaattgcatttgtttacccacaatcattggtgatacacaacatgcgattgcgtagtcatcattgttgaagtctggacgcattaaatcatcgttttcgtattgaactgatgaggtatcaatcgatacttttgcacagaaacgtttgaagttttcaggtaattgttcagaccaaagaatggttaagtttggctctggggaagtacccatgttgtaaagggtgtgtaaaatacggaatgtatttttggttactaatgtacgaccatctaaacccatacctgcgatggtttcagttgcccacattgggtcgcctgagaataattgatcgtattcaggtgtacgtaagaaacgaaccatacgaagtttcataactaagtggtcaactaattcttgcgcttcagtttcagtaatttttcctgcttttaaatcacgctcaatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcatatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccgggtgcgtgagagataatggtagatggtgtatgttcatcaaaatctaatggcgcgtgagtacggttttcaattttaattccttccattacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataagtaaatctttaatgcgttttggttaaataacgttggaatacaccaatacaaattgccccgccgacaatatttcccaacgttacagggattaaattcttcacgatgaaatggtacaaatctaaatctgcgtatttcatcggatcaacgccgatttgttgccaaaattcaggtgtactaaaatgtgcggtaataattcccatcggaatcataaacatattagccacacagtgttcaaatcctgatgcaacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattgaccatttgctgccattgtttgtccactaaaccaaataacagccgcaataaataaaccaccaacgaagttgcccaaatatactacgatccaatttcgaatcatttgtgtcgtggtgattctaccgcctacacgggcgactaaagttaaagtagaagaagtgaataattcagatcctaaaatcaccaccataattacgcccaaggagaatactaacccacctactaacttggttaatccccaaggtgcgcctgcactagcagtttgtgttgtcgtgtaaaatacaaaggctaaggcaatacaagcaccagcactaataccagacataaacgataaaaatggacgtttatttgctttataagttgctgtattttctgcataatccgttgcttcaacaggtgtgagcgcaacagaagatagtttttgattttctgatgccataatcaaactccaactattgacattgaaaaaattgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagcacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaattttggttaattttaagtgcacttctttatacaggagcagattatgtattatggtttagatattggtggcacgaaaatagagcttgccgtattcaatgaagaattagaaaaattatattctgaacgggtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaataattcaacaaactagtggggcgtattcaaataatatgccctttgtttttgaaaaatatttagaatattctaaatttattagattttttcttttttgtttttcttttctttagagaaattattaaaaaatctcgccttttcattgaaaaaccatacaatcaaattatttatcgcttgagggatgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcttttctggcgtttttcttatgggtaccgagtccgaattggtatacca

SEQ ID NO: 557 - DNA, 8845 bp, H. influenzae
ttctttcttttatcgtttttcctaatttttcacggtaaacaggttaaaattttactcacaataaatatccgtatgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaataatgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaattatgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaataatttactattcttatattcttaaaagtgcggtgcaatttgaaaagaatttcatcgcatttttattagtgaaataataagcgattgctcgttattattaagtgaccattggtgaaaggagacgcccatttatgggtgagggagcaatggagggcttcagtccgcctttttgcttaccaaccttgttgaatatatggttcattattaattgatggaatttatacgctttaacgagaatattccattaactaaaccatttaataaaacaaatgtaaaacagtgagcttattgccaacttagattttcttattatacatttaaccaaaacgtcacaggcccatcatttgttaagctcacttgcatatccgctgcaaattgccctgttgaaacaggtaatttctctgcgcacttttggataaagtattcatataattcattagccaatgctggggacgcaccttttgaaaaactcgggcgtaaacctttttgcgtatccgctgctaatgtaaattgcgaaacgataagtaattccccctgcgcttgttgaacatttaaattcatcttgtcattttcatcactgaaaattcgataattaagcactttttcagcgagtttatccgctttttctcggttatcttctttttctacaccaagcaaaactaacaaacctttgccaattttccctattgtttcgccctttacattcacttttgcttgagacacacgctgaattagggcgatcatttcaatccctcaataaaactcggtaaccattcttcagcataactttcttgatcatccacgtttaacacgtcaatttttaaagtctcacaaatttttaccgcactttttgcttgaagtgtttgctccactttgtccgctgcatagcaaaaagtatcataatcagaactacctaatccaacgaccgcaaagcgaacatctgaaaaatccttttggctattcgctaattcatcaaataggggttttaaattgtctggcaattcgcctgcaccgtgcgttgaagtgacaatcagccaaattttctcgttttcaatgtcagataaatttggtccgtgaaaaagtgcggtggaaaaaccttgagtttctaaaacatcgtttaaatgctcggcaacatattccgccccacctaaagtgctgcctgaaagaatacaaatgtgcattttattatcctatatttattttcttctcaaagagaaaagaaaattattgaaatgattaataataaaaaggcttagaaaatctaagccttttattacgattaaacgttatcaaacttaccaagtaatgaacgaatatgctcttgccagttacgatgttcgtttttcagctgttcattttcagtttgtaagttttcgatatttctttgagattctgcgtttttctcttttaattcttcaacttctaattgaagtaattggatagtttctaccgcttgtttaattttttcttcaagctggtctaaaatttctaaagacataatgatttccttttaaatatgggtaagtttaggggtattttacccagtaaatttacctttttaaagcattgaataaaaatttattatgcaaacgattactcagtgatagaatgatgctatttttgccataatcttgaaaaataagcagaaggagaataataatgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatttagctcaaacaaacaacatttcaattaatttaatctgctctccaaaaagctgaacaaatgacttactaaacagggagcagattttaaaatgtcatttttaaataattaaatcattttttctcaaaaaaatatcaaaaaagatattctaaaaacaaatatattcatatatgatataaaaaatattttattaaaataaaagtatcaaatatgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaatgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagcaaggtacggaaaaataggtgcagataatgagcaatatgtgagttatgaacaaattgctaagtttattttgcagcacactgaaaaatcatttagctcagcaacgagaaatttttcgtcgaatatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataaaatccaaagggaattttcaccgcactttttctctccaacaaaaaaatcgcacctttaacagtgcgattttttcttatattaatttaggacattctgccgttttctataccaattacctgatcgcaaatagccatggtagattggcgatggctgacgagaataatcaatttctcagctttagcatcgagtaatgatttcaaaatcattgcttcgtttaagctatccaaattactggttggctcatcaagcaagataatcggtgcattatgcaagaatgctcgggcaataccgatacgttgtttttcaccgtcagagagattgccgcccaattcggtcatttttgtttgataaccttgtggcaaactcaaaataaaatcatgaattgaggctttcttcgccgcttccataatttcttctaaggttgcatcacggcgcgcaaggcgaatattttcttcaatgggtttcgttgaaatataggtttgctgagtaatgtacgccatattgtcacgcaactgcaagtgttgtattggtaaggtttcggcggtaattttaatgctacctgattttggatcataaaaacgcatcagcaatttcaataaggtacttttaccgctgccgcttctgccgtgaatacctaaaatttcgccttttttcacagataagctgacatccgataaaatttgttcttcgccgtaagcgaagtttaggttctctacatcaatgcgagaaacatcttttaaatctaccgcactttctacatcttttaactctggctcttccgctaataaacttaatactcgttcgccagaagccaaagtttgtaataagttgcttgaaaggttacttaaggcgataactggcccatagctcgacattaataaaataacgccgattaaaaaggcagcgaaatcaattttatctaagctaaacaaaattaagccagtaaacagcataatgatgttgaaaacagatactgccacttcagtataaacacgaactttcgcttcttggtctttaatgcgttcaaaggcggtatcaattttttggctacgttgttggatttctgctaaacgttgttgtgcatagccaaaaagctgaatttctttcataccacgcacgctgtcaaggaagaaatcattcatttcgccgactaattcacgatagcgtctgccatcttcacgagccaatttggtggtgataatcggtaaaatcacacctaccgttaaataagcggctaatgcgacaactacaaaccaacctgaaagatgggcaaagaccaacaatagaatcgcagaggtaaagaacgcaatcataattggtgcaatggtgtgtgcataaaatacttcgagcaattcaatatcattggttactaatgacactaattgccctgcttgtttatcttgcaacttcacaaaagccaaacgacgcaaagaagaaaacactttgtcacgcaataatgcgagtaatttaaaagcaatataatgcccagacatttgctctaaataacgcaatacaccacgagccaccgctaatacgataagtgcggtcaaaatgccagaaaaacttaaatgggtgtcaaagtttaagagatttactaaccccattgcaccaaacaccataataaagatggcagcaaggaaaccgagcgtccccatagtaatggtaaacgccataatgtgtgcaagtggagtcactaatttcaacaaatgccccattacaacaaaaccatttttacgcatttgccacctctctaatttgttctaaatctttttgttgttggaacatttcagcatacgcaccttgttttgccattaagctttcgtgtgtgccttgctcaatcaatttgccttggtcaagcacattaatacagtccgcattcacagcatttgccaaacggtgagaaatcatcacaatggttttttgttgtttaaattgttgaataaactgcaaaataatttcttcgctttccacatcaatattactggtcgcttcatcaaaaatataaagctcggcattgtgtaacaaagcacgcgctaaagctaaacgttgaatttgaccgcccgataaattcgcacctcggcttaatagctgcatatctaagccgccattttcgcgtacaaattgggcgagattcacttgttctaaacaagcataaatttgttcatctgtggcatcaattttcgccatcgtcatattttcacgcagcgagcctttaaacacataactgctgtggcttactaatgatactttttgatagaaagaagtgcggtcaatattgagggcgttttgtccattaaacaaaatctcaccttgttgcgcttgattaaaacccatcaacaacgaaactaaggtcgatttaccgcaaccacttttacccacaaataccgtaagctgatttggtaaaatactcaaatctaaacctgtaattgctgatttttcttcactataagaaaaatgcagatctttaatttccacttgaacgttattttttgcttcaaaatccaccgcactttgttgggtttccactggcgtatctaacaatgtgaaaatcttatctgaagccgctttgccattcatcgccacatggaagaatgaaccaagcaaacgaagcggaataaagaactcggaggaaagtagaataaataaaatcacgcctaacacgctgagttgtgcattttggaattgcaatagtgcggttaaaatcccgatagctgcgccaccataagcgagtaaatccatcagtgaaaccgagttaagctgcatagtaagcactttcatggtaattttgcggaaatgctcagcctctttatccatcgctttcgctttataaccatcaa

SEQ ID NO: 558 - DNA, 9091 bp, H. influenzae
  misc_feature (991)..(991): n = a, c, g, or t
  misc_feature (1111)..(1111): n = a, c, g, or t
  misc_feature (9038)..(9038): n = a, c, g, or t
  misc_feature (9067)..(9067): n = a, c, g, or t
ccagctgttagccacaaattatgttttttaaaaaaagtgtttctattggaccactagtcagagagccatatgctgttttgcccagcggaaaaaaatgaaaaaattggggttgtaaaattatttacaacaatcggtcctattaaaccgtagggctttcggtcttgtgtaaaggaaaagcaaaaacatattccgatcttgcccttccgattatctatgaggagcctttagatttttagctcgtgccagattaaagaaagctttttctgaatcagatttcccgtggcgcgtagatcttctaaattgggctacaacgagcgaagattttagggaaattatccgtacagtttatgttgttattcaggaaaaagaaaaaacggtcgaaaaaccgaccgctctttagacaaaatataaattaagccgccaccattaccatcgctgggcgaatgactcgaccacttaaggtgtagcctttttgcaatacgacgctaatttgattggtttcaaagccttcagctggttgcattgaaatggcttgatgtaaatcaggattaaaggcttcaccgacaactcccacagcttccacgccaaaacgcccaacggttgaaactaattcttttaaggttagttctacaccgtcaaataaggcttttacgctttcatcttctttatttgctggagtggcaagcgcacgctctaggttatcgatagtattcaaaatgtcttttgaaaatttttccaaagcgaatttatgtgctttttctacgtcttgttcagtacgacgacgaagattttcaatttcagcacgagagcgaagtaaaatatcctgttctttgtttgccgcttcttctatttgagtttttagctgctcttcaagctcttgcacgcgagcaattgcttcttctaaaggatcaaattcttgagaaggatctgcttgttgtgcttcttccacaacgacttcttcttgattttctacttctggggatttcaactnttttgttctttgttctgacattttttttctccgtaaaacaaaattgattaatcgtaattgggcatagtgtagcaaaaaacgatataatgacgaaaatgttaaattcaagtgcggtcattntatgaatcatttatatcgttcctttaaaaccattgctcttgtaggtaagcctcgcaatgatattaacttacaaatgcacaaaaacttatttcattggttaatggaacgtggttatcaagtgttggtggaaaaagaagtcgccataacacttgagttaccttttgaacatcttgctacgttagaagaaataggccaccgagcccaattagccattgtgattggtggagacggcaatatgctagggcgcgctcgggtattagcaaaatatgatattccattgattggtattaatcgtggtaatttgggatttttaacggatattgacccgaaaaatgcctattcccagcttgaagcttgtttagaacgtggcgaattttttgtggaagaacgttttttattggaagcaaaaatcgaacgagcaagtgaaatcgtatcaaccagcaatgcggtaaatgaagcggttattcatcccgccaaaattgcacatatgattgactttcacgtatatatcaatgataagtttgcattttctcaacgttctgatggattaattgtttctactccaacaggttctacggcttattctctttccgctggtggacctattttgacaccaaaccttaatgccattgcattagtgccaatgtttccacataaattaacttctcgccctcttgttgttgatggggatagtaaaatatcgattcgttttgctgaacataatacctctcaattagaagtgggctgtgatagtcaaattaccttaccttttaccccagatgatgtggtgcatattcaaaaaagcgagcataaactccgattgcttcatctgaaaaattataattattacaatgtgttaagtagcaaattaggttggttaaaatcattttgattatggtaaaaattttcgattgaaatagatttgacaaaatactgtaaaaaatcctttactgtaaattaaatcagttatatcatattaaatatacagttaaaggattttgctatgcttactcaacttactatcaataattttgcgattgttcgtcagcttgatattgaattggcgaaaggaatgtctgttataacaggggaaactggtgctggaaaatctatcgccattgatgctttaggtttatgtttcggacaaagagtagaaacctcaatggtgcgtgaagggcaagagcgtgcggaaatttgtgcaactttccaactagaatcgcaaaatcctgcttatcactggttgagtgagcaagaattacaggatccagataatccaactgaatgtattttacgtcgtataattaatgcagacggacgttctaaggcttttattaatagtacaccagtatccgcttctcaattaaaagaaattgctcaatatctcgttcatattaatgggcaacacgcttctcaattattgttaaaaaatgactatcagcttcagttagttgataattttgccgctcatcctgaattacttgtgaaaatgcgtgaagattatcagacatggaaaaatcttcaaaatcaagttaaaacctttcaacaaaaagtggcggaaaatgaagcacgtaaacaacttttacagtatcaagtggatgagttagatgaatttaaccttcgaccaaatgaatatttggaattagaagatgaacaacgtcgtttatctagcagcgaacagctaacccaactttctcaatcggccctgcaaattttaagtgaaaatgacaccgtaaatatcgatagtttgctttatcgtgcgacacaatatattgatgaattagctgaacttgatccgcaatatgctgaagtgcaaaatatgttgaatgatgcgttgattcaagtgcaagaagcaaccagtgaagtgcaaaatttatcaagtaatatcgagcaggatcctcaacttttacaggaaatcgaacagcgaattagtcaggctttacaacttgctcgtaaacatcaagttaaacctgaagatcttgtagaacagcacaaaaaattaaaagcggaattaaccgcacttttggatttttctgaaagtgaagagatgttgattgagcaagaaaaacgagcatttgaacaaatgcaagcaacggctacagcattaacagcaagtcgtcagcaatctgcaacccgcttagcgcaaaatgtcacacagtcgataaaacaacttgcaatggaaaacgctgaattttatgtagagttgaatacggatttagataaagtgagtgcaaatggtgcggataatgtgattttcactttgcgtagtaatttaggacaacaaccgcagccattagctaaaattgcctctggtggtgagctttctcgtatttctttagcgattcaagttttaacttctgatcaatcggctattccaacgttaattttcgatgaagtggacgtgggcattagcggaaaaacagcaagtgttgtcggaaaacttttacgtcaattaagtgaacgctgccaagtattatgcgtaacgcacttgccacaggttgcttgtcatggccatcatcagttcaatgtagaaaaatttactgttgataataaaactgaaacaaaatgaccgcactttcacaagctgaacgtgtaccagccttggcaagactcttgggcggaagtgaaatcacagaattagctctagccaatgcacaggaaatgttagatttggttcattaaaaataggattgaatatttagtttttgcgaggtttcaagaagatttgtgatgaaggctatttttgaaacgtccacaagccatattttaggatacaaataacctatcccaaaatgcttgaataaatgaccgctctttgacaaattcagtttcatccacaacgggggatttgcctatcaaatttaaatggtgaatagcattgcgtaaatcaacataacattgttttaatgtgtcgcagtctgtttggctaataattttagcctctgctatatcatcgaaaatacgaacattgtctgaccattttgttagttgtggttttttcggggcattggcaagcattaaatattgagcaataaattctatatctgtaatgccaccgcgatctgttttaaggttaaattcactgtgttttgagtgagataaatgggcaaacatttttttccgcatctcaacaacatcttgttttaattgttcaatatctcgtgatgcagaaagcacttgttggcggatatgctcaaatttagctttaagagatgattcgccaaatactggacgagcgcgcacaagtgcttgtttttcccatgtccaagcgtcattcaattgataatgggaaaatgcagaaagagagcagccaattaagccagcatcgccagaagggcgcaggcgcatatctgcctcataaagtacgccagcggaagtatttatgctgaaaatactcacaatcttttgtgccaagcgtaggtaaaattgattgctatcaatcactttcttgccacctgttgtttgattttctacggcatcgtacaaaaatacgaggtctaaatcggatttataaccgagttcaataccaccaagttttccataaccaataactaaaaatcctttttcattattttgtaaatgttcaggcacgccaaatctagaagacacttgtttccaagctagattcacaaccacttcaataatggattcagcaagataggttaaatgatcgcttactttcattactggtaatgcgcctaaaatatctgccgctgccacttttaatagggttgcttgtttaaattgacgtaaagcatcgataatctgttcttcatcatcagggggtaaacgaagcaaatattggtgtaactctgcaggatattgggtaaatggcaatggatgacgtagtgcttccgtattaagcaattcatctaataaaataggatagcgagccaattgttctgaaataagttgagactgtgcacaaagttcaataacttgctgaagtgcgcgaggattttccaataataattctaaataagtcgtgcgactcgaaattttttcaataatgttcagtattcgggggagcaaagtgcggtaattttcttgttcaaaaatgagtgcaagtactgttggcatcaaatgactcaaaacatcacgcccacgcgacccaatcactctgtgatttaggccgtctttgaattgagcaagcttttctaaaacttcatcaatattattttctgatacaccactctctaataatgtttgttcaatatcctcaaaatctgcttctaaaaaatcttgccattggctatcagtttgtgaaggctcatcttgttcatcaccgattaattgagtaaatactgcccgcactttttcttgtttttgttgtaaagtgcggtaaaaatcgtcccaattttctattggataatgtttttcaatggtttgattattttcatttaaacaggtgaaagttttacatgccttgactaaacgaatttgatctatttcatcggttggtagtgtttgcgtttgttgatcgttaatggcttgtagaatgttttctacgcggcgtaaaaaaatataactttcacgtaaatcgtggaattgttgttcggtaattaatcctagtttggtaatttcaggcaagatctttaagagtgaatgttgttgcagattgatttctcgcccgcctcgaatgagttgaaaaacttgtacgataaattcgacttcacgaataccaccagcacctagtttaatattatctttcaaaccacgacggcgtacttctcgctcaattttgcctttcatttcacgtaaagattgaatcacactaaagtcaatatagcgacgatacacaaaggggcgtaacattttttgcaatttagatacgttgggatcctttgtttgtacgcccaatactcgccctttaatcattgcatagcgttcccaatctcgaccttgatcttgataatattgttccattgctgcaaagctgagaacaagcgcgccgctgtcaccaaatgggcgcaagcgcatatcggttcgatacacaaaaccatcagaggtaaattcatctaaggcagaaataaggcgttgccctaaacgtgtaaaaaattttccattatccacagaacgtcgagcattcgtattttcaatagatgtttccccttgtgatggataagtgaaaattaaatcaatatccgaggaaaaatttagttcaaagccgcctagtttccccattcctaggatataaagctgctgcggattgccttgttcatccattggtgtgcctatctccgcacaggcttgatgataaagccaatcgcgggcagcgataattaaactctctgcaagttgtgaaagctgaacaaaaatttcctcaacagtcgcaagattcaaactttgacaaaaacttaattttgccatttcaatgttacggaattgacgtaatgtttgatagagtgcagtttcgtcatgtacattggctaactctctattcaaacgttcaatataggcagtgcaatctgcaaaacagggggatttttcccaccattgtttcactaagtgcgggtatttttgcaagactttttccacaaagtcagacattgctatggcatagcctaattgataaacaggcagttctggatgatttgaattttgttgaatagcttcgtgaattttttctggggaaagctctggaaaagattggcacaggattgtgccaagagattgtaatttttgttcaatgagggcagaaagtgcggtcattttttctaacctttttgataggaatctaagtgacgtaatacggtttctttcgcttgttgaggttgcaaactatctagccattgtattggtgttttccagccgcgcagccaagtgagctggcgttttgcaagttggcgcgttgcacaaataccacggaaaatcatttcctcgtgatcgtaatcgccttgcaaatattcccacatctgacggtagcctacacagcgaattgacggcagattaatatttaaatcgccacgtgcataaagtttttccacttctgcttgaaagcctagttcaatcattttatgaaagcgttgttcgatgcgttcatgcaaaacatggcgatcttgcggcgcaattgcaaattgcacaaaatcataaggcaaggcttcgcctttttcttcagtcagctctgtgagtgattttcccgtgatataaaaaacctctaaagcacgattgattcgttgagaatcactgggattaattcgggcggcagaaatgggatcgattttggcgagttctgtatgcaatgctgcccaaccttgttgagctgctttttgttcaagctcggcacgaatattttcatcagcagaaggcaagggagaaagcccttcaattaaggctttgtaatacaacatcgtaccacccactagtaacgggattttgccttgtgcggtaatatccgccatttcgcgtagcgcatcatcgcggaaattcattgcggaatagctttctgatggatctaaaatatcaatcaaacggtgaggcgcaagagcaagttcttcttttgatggtttcgctgtgccaatatccattcctttataaatgagcgctgaatctacactaatcacttcaactggaagcgagcttcgtagttgaatagctaaatccgttttgcctgaggccgtagggcccattaaaaaaattgcggttggtttcatgaagaatctaaatttcgtctaataaaggctgccaattaacaggtttgagtaattgggtgaatgccgtgcgattcgtttgcgtgagtaaacgttctgtatcgcttaataaattgagtgcgtccgctaaagcgtcaaaggttttacattctaattgtgcgcaaagtgcggttaaaaatggtgatgaattttcatctctagtcagcattgccatcaggcatttttgtagattttgtgtgcgtaacacatttggcactttatttaaggttaagcgtaattgtgcttgattttcgataaattcaaagccaatttttttgaagttatctgaatattgttgccatgcttgaaattgtgcctctgttaaacgaaatacgattggaatcaacaatggttgttgttcaatctgtatttgttgtaaagccaattgccattgcaagcgttgtaatttttccaatgaaagcaaaaagaaatcttggttctgttgtaataagagcgcgcgattttcaataagtgaaagggtacgcagatgtgatgagcactcaattatttcagttgagatgattttagctgtatctgaaatattttgttgtgctgtatccgatatatccttttgcgctgtaggcggtaacgtgcgtaacaattcagcatataaacgttgctcagttttactcggtgcatcagaacggtaatctcgataaccagtacttacatgatttggcaacactggtgtgttagaaaagtgcggttgattttgctgtggtttttcataatattttggcgcaaagctattttgccccgcagctgcacgattaggacgaatgctataattcggttggggctcacgcactgtattttcttcgtgattttctaccgcactttggtctgtgtgccaattaagctgttcttgattgtttagtgcataacttatgccttcgtaaataaaatcatgaatgaggcgttgttgatgaaagcgtacttcatgtttggttggatgaacattgacatctacatcgtgcgggtttaaatcaataaacaacacaaacgcaggataagcatcggttggtaaatattgagcataggcttgtcgaatcgcatggctgatcactttatctcgaaccattcggccattaatatagcaataacttaaatcattttgagttcggctaaaatttggtgtcgccacccaacctgataaatgtaaatcatcgtgtttccaatcaattcgtaaggcatttttgacaaaatcatccccacaaatcgcggcgacacgttttagttgngattgattgttcggggggtgctatagagngacctgcaggcatgcaagtctggc

SEQ ID NO: 559 - DNA, 8832 bp, H. influenzae
  misc_feature (8633)..(8633): n = a, c, g, or t
tttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaatggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaattctttatttttccttatatttgaaacttaaaatccaggattgatcgttatctcaaaccctgttacttgcggaaattcttcttgaattagtgttaataattcaatttgtttaaatagaatcccctgccgaacaatagcattagacacttcaataaaaattaaatgatctgttatgttgccaatacgaaatttgccgtgaaattcctgtggaaaaatgcggttaaatttttgattaagttcattgatggcaagaccttttttgattattttggcaaagggcgattgctcaagcacatccataatattgactgctttttgataacgatcagccttgttttccataaagtcagcccccagtaaatgacatcagtttagatttccgctacaatacacgcaattttcataataaacaatgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaacttacgtttctgcagctgcagcagcggntaaagaaagtcgtggtaacgaagctcaagttgctgaagaattagcagctgacgcagataatttaagttttgcataaggcgaagcctttataatcaagcgataaattgcatagggcctaaaattagcccctatattttatctaaagaggcggcaaaaaaaccgcattttgacagaggatttaaaaatggctgaaatccag

SEQ ID NO: 560 - DNA, 8894 bp, H. influenzae
  misc_feature (2222)..(2222): n = a, c, g, or t
atccccttgcatcagaatttcgttatcgcaaatttgttacccgtccaaatagcttattgattaccctttctcaatctggcgaaacagccgatactttagctgcacttcgtttagcgaaagaaaagggctacatggcagcattaacaatttgtaatgttgctggctcttcgctcgtacgcgaatcatatcttgcatttatgactcgtgctggtgttgaagttggggtggcatcgacaaaagcatttacgacacagctcgctgcattattaatgctggtaacggcacttggtaaagttaaaggtcatatttctgtagaaaaagaacgtgaaattattaaagcaatgcaatctttacctgctgaaattgaaaaagcgttagcctttgatagagaaattgaagctttagcagaggattttgctgaaaaacatcatgcgcttttcttaggccgtggtgcgttttatccaattgcggtagaggcttctttgaaattgaaagagatttcttatattcacgctgaggcctatgcggcaggagaattgaaacacgggccattagcgttaattgatgctgatatgccagtgattgtcgttgcaccaaataatgaattattagaaaaagtaaaatcgaacattgaggaagtgcgagctcgtggtggtcaattatacgtatttgccgataaagaagcaggatttacgccaagtgaaggaatgaaaatcatcacgatgccaaaagtcaatgatattgttgcaccgattttttataccattccaatgcaattactttcttattatgtggctttaattaaaggcactgatgtagatcaacctcgtaacttagcaaaatcagttaccgttgaataaagtgcggttgattttaatgtaataaaaaaaacggtgaaatttcaccgtatttttttagttaaataatcttctttgtttccgtgttttaatcacttgtgcgattaacaataatgtgagaataaccacatatagtgaaaaaataaccactagccattgcaccatcgttaaaccaaataatgaccattggctttcattacaagagccagttgggttaaatataaatggaaaccattgatgaaatggtaaagtctcgggaaaatttggaataaactcacattgtttccaaggagctggattcatttgcaaatcaagatgacgaaatgaaatcaataagcccttaatactgctgaataaacctaaagccaaggcgattaatcgaagtatgaaagcaagaggttgaagtaatgcaataatgcccgctacaaataagccaatcattgctaaacgttcataaacacagagcacacaaggttgtaagcccattccatattggaagtaaagtgcggtggattctaaggctaaacttgaaaaagccaataaaaaccacacaaaacgtttttcggaaaattgttttaatagcgcgagcattttttctccttaaattggcaaaattaaacctaaacttgctaaccaaattgtggcagctggtaaaataaattcaatagccagtaaaccaatgattgaaagtacaatcgtgtaaggtaaagccatataaaccattctgccataagaaaggcgaattaatggcgaaattgatgaagtcaataagaataagaaagcagcttgcccatttggtgttgcaactgatggtaagtttgtacctgtattaatggcaacagaaagcaattcaaattgatgcggtgcaattactccatttgtcagtgcagctttagcttcattaatataaaccgttgcaacaaatacattatcagaaatagaagaaagcaagccattaaacaaatagaataaagcaagttgtgtattttcttccgcagaaagaacgaagtgaataattggtgaaaaaagtttttgatcaataattactgcaacaacagaaaagaatacaacgagcaatgcagtaaagggtaaagattcctgaaaggctttaccgatagtatgttcatccgtcacaccagtgaaagacgtagcaaaaatgatgatacttaaaccaattaaaccgactgcggcaagatggaatgctaatccaagaattaaccaaattgcgattaacgcttgcatacctaatttaattttatcttgtttagacattttttctgaattagtgcgatctaagtctgataagactttccacacttcgtctggtaatttctcgccataaccaaataatttgaatttttcganccaagaaacaagtgagtaatccgcagataaacacaggaatagtcacgggtgccatactggaggaaaaattccataaagttccattttgcttgttctgcaataattaagttttgtggttctccaacaacggtcattacaccaccgagtgcagttcctacacccgcatgcatcattaaactacgtaagaatgcacggaatttttctaagatttcgtgctgttgttcaataatttttctatcgtctgaaatatcaaccgcatcaattaaattattgcctgatgcaactttgtgatacacaccataaaatcccattgcgacactaatgataacagcaacaaccgttaaagcatcgagaaaagccgataaaaaagcagcactaaaacaaaaggcaatagaaagtgcaattttagaacgaattttgacaagtaatttagtaaatacataaagcagtaattgtttcataaagaaaatacctgccaccataaatatcagtagcaagatcacttcaaagtttgccataatttctgctttgacgtgtttggcatttgtcattccaataataatagcttcaattgctaatagaccacctggttgaagagggtagcattttaatgccattgccaatgtgaaaataaattctgcaaccagtaaccaacccgcaataaaaggactaataaaaaagaaaacaattggatttataataagaaaaaccacaatggcaagtttgtaccattctggacttgccccaagaaagtttttcataaaagcctgaatgtttgtcatagtgaactccattatttttatcacgcgaacattgtaatatatccccctttaaaggataataaaaaccaagtaatttttttataaaattgcattttttttgatttttatctgatttttaattgtaatgcaaaacaataacgacattttaaaagcccaaagtccagcagctttagcagaggaatatattgtaaagagtatttggcaagatgtttttccttcgggcagtaatttgccatcagaacgtgatttagccgataagattggtgtaactcgcaccaccctacgtgaagttttacaacgtttggctcgtgatggttggctaacaattcagcacggcaaacccaccaaagtaaataatatttgggatgctgcagggccgaatattattgaaaccctaattgctttggatatgcagtccgcgcccttaattattgataatatgctctctttacgtagtaaaatgtcggaatcttacatttatgaagcagtaaaaaattcccctcaaaaatcaaccgcactttttgctgaattagagcaattacaaaacacagcacaagattacacagaatttgattaccaattatttcgtcaatttactgttgttgccaacaaacccttttatcgtttaattttcaatagtttaaaaggtgtttatcagcgaatagggttgttattttttaaagaaaaaaaacaccgtgaattaacaaagcaattttatttagaaatgcaacaaatttgtcttgagggaaatgcagatgcagtagtggattgcatccgtaaacataatttacgttcttcaacctattggaaagccattttagaacgattgccacaaaatttatcagattaatactggaagcgaatttaagaaaaaaacataaaacttttcttataattacaaaatcattttcaccaatttatctgctttaattcgtgcaaattttttcaaaagtttttgcactggttctgggtattgattcaattcttctaattcagagtaatgttttaatacttttgtatgttggcgaatttggttttgctctttttccacttgggctaaaagctgttgttgtggatcgtaaattaataagccattttctgcatccaaacgccatgctcgagggttaagattattgcccgtcaataaaatataacggtcatctacccacacaccttttaagtggtaggtattatcgccatcacgccataaacgcaccacaagctgaccattttcaatttgagtctcaaatttttcacagaaacggcgaagattactttcataaagataaggtaatgcccccgccattttgaatggttgttctggtggaatgtaaaaatcgtttgcgactttatcgccaacaataatttctacttgtttaccgctttccaataatgttgctattttatgttgcaatgtgcgtgggaaattaaaatatggcgtacaaatcaccaatttttcttgtacttgtaagaataaatcttcaattacttgatttaattcgttgcccgatgcgcctaagccaaacagtggcgatacgcttaaaacattcggtaatttcaccgcactttttaatgaatattctccattttgagcaaggtctttacgataagctcgaatattaccgcggatctctttagtacgagggcggttggtcacatcaagtggataaactgcactgaaatctaacaagtaatcattgatgaaatttaccattgaatcagctaattcggcatgagtgattttttgatagcggtcgtaacgatatttttcaaattgatgaagatagacattattaatacttgcaccgctataaagcaccgtatcatcaaatacaaagcctttgacatgcaatacaccaaaaacttctcgcgtattaattggcacgccaaagaacatattcggatcatcaggtaactgataagtttggcgttgctcgcaataccagtctgcattagtggcagatttttccgcccctaataaattgcgttgtgcacgatgccaatctatgagaatttttacatccaagtgtggattttcttgcttcacgcgataaatttcatcgagaatttcctgtcccgcttcgtctttttgccaataaagtgcggtgacataaatacgtttttttgcgtttctgattaattcaataatttgagttttaaattcagccgagctacccaaaaattcaatttgctcagcttgcaaagcaaggaatggcaaattatttaaattttgttcagctcgtttggttttattgattaacataatccatctcgtgattaaagactagtgcgttagtttacaatatttcacgtgcttattaatagaaaaaaggctttttttcgttataatgctcacaaattttagcattttttggctaaaaaacagccatttttactcagggaaaccctatgaacgacaaacgcaaaccgtcttttcaatccgcaggcaaaacctttcaagaacgctcagtaggtgaaaaatacagagaaaaaccaagccaaaatcgaccgcactttaatgataaatttaatggaaatagaaacgaaaaatctcgttttcctcgtgataaacaagaagtgaaagaaactagaattaagcaactttctttatctcgcgcaccatcaaataaaaatacagaacaacctaaggttcaagtgacaataaaaagtacgggtacggtttataaaacgaaagaaaagaaaactggtgcgctttctcctcgtgcgcctgaaaaaattaagaaaaaccgtgcggaagaaatgaaggtttacggtgaaaatgcctgtttagctttatttgcagagcgtcctgaaagtattgttcgattgtgggcaaccgtgcaaatgtcacacaaaattggcgaggtattgagttatttagccgaaaacaagaaggcttatcacgttgtagatagtgaagaattagcccgagtgagcggaacagaacatcacggtggcatttgcttattggtgaagaaaccgcgtgctttcacgttgcaagggtattttagatagtgtatgattaaaggggaaacgatttcccctttaaaatttcaaataaaagtctttagtcaattcaataaacgcttcagtgtattgattatccgcatcataaattaccaattgatcttgcattaaaacttcgggttgtttggcaaaggtaagcaacattctctggggcgtttttcctattttagtgatgacattcgtctgttttatgcaaaaaagtgcggtggattttgtgagcgttttgcctgcatcataaggcaaaacaaaacttattttcccattttccgacaagcgtgttgcagcccattctaaccaatttaagtggctttgcttggtataacgagccaattctcgttcttcatttttacaagcgataccttgttcaaaataaggtggatttgccacaattaaatcaaaggtttgttcagtggtttgtaaaaaatgttgtatatccgcttgagtaagttgaatgcgatttttccacactgaattattgatgttttcttgtgcttgttttgctgcaatgggatccaactcaaccgcttgaatttgacagttttcttcagttcgttgtgctaacattaaagtcaataatcctgtgccactgcccatatctaaaatatttttacaatgctttacatcagcccaagcacctaacaaaatgccatcagtgccgactttcatggcacaagaatcttgattgatatggaattgtttaaaggtaaatccgctcataaatttttcgtaaattgaccgcactttcaggtataatcctcgacgattttaacaaagaaccgcacaataatgaatttatcccaatttgaacaattcgatctttctccagaacttttaaaggcacttgagaaaaaaggttattcccgcccaacagctattcagatggaagccattcctgccgcaatggaagagcgtgatgtattaggctctgcaccaacgggaacagggaaaaccgctgcttttttattacctgcgctacaacatttattggattatccacgccgtaaaccagggccaccgtgtattttgatattaacaccaacccgagaactggcaatgcaagtggctgaacaagcggaagaattagcgcagttcacccatttaaatattgcgacaattacaggtggtgtggcgtatcaaaatatggtgatgtattcattaccaatcaagatttggtggtggctacgccaggtcgtttattgcaatacattaaggaagaaaattttgattgccgttccgttgaaatgctgatttttgatgaagccgatagaatgttacaaatgggatttgggcaagatgcggaaaaaattgcagctgaaacccgttggcggaaacaaactttgttgttttctgcaaccttagaaggagagttattggtcgattttgcggagcgtttgttgaatgatcctgtgaaagtagatgcggaaccaagtcgccgtgaaagaaaaaaaatcaaccaatggtattatcacgcagacagcaatgaacataaaatcaaattgctcgcgcgttttattgaaactgaaaaagtaacccgtggaattgtatttgttcgccgtcgtgaagatgcgcgtgaagtttctgaaacattgcgtaaacgaggcattcgttccgcatatttagaaggcgaaatggcacaaactcaacgtaacaatgccattgataaattgaaatcaggtattgtgacggtattggttgcaacagatgtggctgcgcgtggtattgatattgatgatgtaagccacgtgatgaattttgatttgccctatagtgcggatacttatttgcatcgaattggacgtaccgcgcgagctggcaaaaaaggcacggcagtctcttttgtcgaagcgcatgattacaagttgctaggtaaaatcaaacgttatactgaggaaattttaaaggcgcgcattttagcaggtttagaacctcgcactaagccaccaaaagatggcgaagtgaaatctgtcagcaaaaaacaaaaggcacgcattaaaaaaaaacgtgaagaaaagaaaaaaacagaggcaaagaaaaaagtaaaattgcgtcataaggatacgaaaaatatcggcaaacgacgcaagccaagtaacagtaatgtttaattaggtatgatttaaattctgttttatatcacactagcaatgtgggtttcttgtattggtattaactaaattacgcattaataaagcgtaatttaagttaatatcttgtggtacatttaagaatacaaaatgcccatcacctagtgctgcatcaaccgtttcatttttacgatttagcattttttcaattttgaaattaatattgccttgtggtgtcatcatttctacattgtcgccaagtaagaatttgttttttactgctacttcagccataccttgttcgttacgtttgcccgtaaattcaccgacaaattgctgacgatcagaaatagaatagccatattcgtagttttggtattcatcgtgcgtatggcgacgtaagaaaccttcggtataaccacgatgcgcaagggattctaacgtatccattaagctttcatcaaatggtttgcctgcggctgcatcatcaatggctttgcggtaaacttgagccgttcttgcacaataataaaatgatttagtacggccttcgatttttaaagaatgcacaccaagtgcggtcagtttttccacatgttgtacggcacgtagatcttttgaattcataaagtaggtgccgtgttcatcttcaaacgctgtcatttgttcgtcaggcttttgtgattcggtataaaggaagactttatctgttactgtgccatcgcctaaggttggtgctacatttttcattcgatttgttgagcaggatcgatttcggc

SEQ ID NO: 561 - DNA, 8390 bp, H. influenzae
  misc_feature (8361)..(8361): n = a, c, g, or t
gcggcccacgtagaaaggtcgaatttacgcgcccaggtaaaacgcgagttttttttcaagtttttctttgggagcgggaagcataatattttatctttatgctgcctgctgtacccctggaatacgagtgagtagtttatccccaagagcttgtttagttgattcaagcggttcagcacgcctgaattaaacaagctttagaacgataaatcacgtccacttcttttaagccatttgcttcaagcgttgcccctgatgatactaaatcgcaaatcgcataagcaatacccgcactaggtgcgacttctactgaaccatttaataaacaacttttaaacgacaccccattctcattcatataacgtttgagcaaatgcgggtaagaagttgcaatacgcctattagcaagatctttcacattctcataatgacaatcgcgatcaaccgcaagtgatagacgacaatcaccaaaatcaagttggcgaagttttttgtatgtaactgtttcatttgctgcacggcgaccaagctcttcctcttctaacacattttcgccaataatcccaagatccactacgccatcaaaaatcaatccaggaatatcatcatcacgtacgcgaagaatttcaatcggcaaattttccgcataagcgattaaacgttgttcattccaattaattttcacgccacattgtttaagtaatatggcacaatcctggcttaaacgcccttttttttgcaaagcaatacgaaggcggtttggttgcattgttgtgtttgtcataatgtttttcctattttaaagttgagataaaagaaaacccctcgaaaattgccttccgagggggtatttattgcttttacactgatttttattacactcggaagatattttattatcttccaaacatacaatcacgcctgaaagataatcaggtgtggtgatgatggtaagtgcagataaaattcatattgtatatgctcgctcaaatgttattagattttatattgccttaaaaatacactttaaaattaaaaaaagcaatttttttgaaaaaaattgtgtttttagtacatttttactatcgttaaaatttatcaaaaatgtttacttaagaggtataattttctagatttttattgtgttaattttcttttccctttctgtgttcatctcgttacaatacttagcgaatcaactaagacaaagctaagacaaaataggagagcttatgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaataggaaagcagaatgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaataagaaagcaaaaaagatcaggcattaccctgatcttttttctatttagtaaagtactctagcacgaattgtgccatcaatttccttcaattttgtcagtaatggtgatgcatcattcgtttctacatcaacgacaacgtaaccaattttcgggtcagtttgtaaatattgtgcggcaatattgaggttggcttcgacgaaaatttggttcagtttgttcaatataccagggcgattttcatgaatatgcaataagcgttttgttccctcgtgctctggtaaagagacttctgggaagtttaccgaagaaagggttgagccattatctgaatatttaacaaatttgcctgccacttcaaaaccgatattttcttgtgcttccgctgttgagccgccaatatgtggcgttaaaatcacattatcaaattcgcgtaatggcgagacaaattcttcattaattgaagcaggttcaacggggaatacatcaattgcggcaccctgaagtttcccgtcttttaaggcttgagcgagagcatcaatatctaccacagtgccacgcgcagcattgatcaaaattgccccttgttttaattgtgcgatacgcgttgcgttcattaagtttttggtggagggcagttctggcacatgtaatgaaaccacatcgcaagaactgagtaattcttcaaggctacgaacctgttttgcattaccgagcggaagtttattttcaatatcatagaaatacacatccatgcctaatgattcggcaataatacttaattgtgaaccaatgtggccgtaaccaataatgcctaattttttaccccgcacttcataagagccagtcgcggatttattccaaacaccacgatgtacttcggcattagcctgtggcacattacgcataagtaataaaatctcgcctaatacaagttctgcgacggaacgagtgtttgagaatggcgcattaaatacaggaataccacgtgcttttgctgcatttaaatccacttggttggtgccaatacagaaacagcctactgcgattaatttgggtgcggcttcaatcatttctgcggttaaatgggtgcgagaacgtaatccgataaaatgtgcatctttaatggcttcttttaattcatcaccatccagtgcttttttatagtaatcaatattgctatagcctgccgcgtggagcgtatcaagtgcgctttgatgcacaccttcaaacaatacaaatttaatttttgatttgtcgagtgaaactttgtttgtcatatttgcttccttatgatttttattatgaattagtcaataattttggcaccttcaggcgtgccgacgattacaacatctgcgccacgcaatgcgaatatcccattagtgacgacacctgcaacattgtttaattctttttccatttcaactggatttaaaatactgaagttgtgtacatctaaaatcacattgccattatctgtaaccacgccttcacgatactcaggtgcgccaccaagtgcgactaattttctgcccacttgtgaacgagccattggaataacttcaactggcaatgggaaagtcgaacctaacacatctacttgtttactagaatctacaatacaaataaattttttcgctaatgccgcaacgattttttcacgagtaagtgccgcaccgccgcctttaatcatcattttttgtggattgatttcatctgcaccatccacataaatatctaagctagagacatcatttgcattaaatacttcgatcccttgtttacgtaataattcttctgatgcttttgaagccgcaactacgccttgaattttatttttgattgtacccaaagcttcaataaagcagttcactgtggagccactgcccacgccaacaattgtgtcagctgttacatattctaatgcagcttgtgcggcgagttttttcatttctaattgattcatttcttttccttatttcaataagtaaacgattgcgttactttattacgagcctatctaataaacaagtataattttttagcgggcgtttttctcaagcaatgttctttcacgactagactatttcacgattaggctattcttcagttaaaaataattccaatagttcattgagaaataacttgccgtgctcagtgatttgccaagaatcagcgttttccacaatatagttttgttgaatggcaaaatcaatttgatttttcaccgcactttgcgacaagcctgtgtaatcttcaaattcttgtttgggaaccgcttctaacaaacgaaagcgattcataaaaaactcaaaagggcggtcaatttctggcacgtttttttcttcgtaaagatattcgccacgcaaataacctttcgggtgcttggttttagaaaagcgagtaatctcgccagtcggaaacgtcaatttcccgtgtgcgccacagccaatggctaaataatccccaaatcgccaataattcaaattatgtttacattgaaaacccgcttttgcgtaagcagacgtttcatattgctggtagcctgccatcgttaaaagttggtgaccttgctcaaaaatgtcccaaagtgcgtcatcatctggtaatttaggtgggcgataagcaaacatcgtatttggttcaatagtcagctgataccaagaaatatggggaggagatagctcaattgcttgacgaagatcatctaaggcttcttccaacgtttggttaggcaaaccgtgcattaaatctaaattgaaactttttagcccagaaactttcgctaaattgaccgcactttttgcctctgctgcattatgaatccgcccaagacgttgtaatttatcatcattgaaactttgaattcccatagaaattcgcataatgcctgcggatacataacctttaaaacgttcagcttctaccgtgccaggattagcttctaatgtgatttcaatattatcttcaaaatcaatctgtttttttatttcttttaagagatacgcaatgctttctgccgagaacaaacttggtgtaccgccaccaataaaaattgaatggagttttcgttgttgaatagaatctttaaagcgttgcaaatcagcctgcaaatcttgcagaagatgataaatatagtcttgttctggtatatcgcctttttgtgcgtgcgaattaaaatcacaataagggcatttttgaacgcaccaaggaatgtgtatataaagggaaagtgggggaagttttagcattgtgttattaacaagttttcaatttggaaaagtataaattaaccttgtgtaaagatgaaattatcatctctaaaatcaataaaagggcttgttttcacaagccctaaaacattcaattaattgaccgctctttctgatttactcgtcactttacggcgtggtgctttaggtttagccttcactttaacaaactcaatgccctctggtggattttccaatgcaaaaccaagcacttcatcaatggtttctaccgcatgaattgcaagattttgttttacgttttctggaattttttcaagatctttaacgttctcttttggaattaatacggttttaattccgccacgatgtgccgcaagaagtttttcttttaatccaccgattggtaatactttaccacgtaaactgatttctcctgtcattgccacatcagcacgcacaggattacctgttaaacaagaaattaatgcagtacacattgcaatacctgcacttgggccatcttttggtgttgcaccatctggcacgtgaatgtgaatgtcacgtttttcgtggaattcagcattgatacccagtttatccgcacgagcacgcacaacggtcattgccgcttgaatggattctttcatcacatcgcctaatgaaccagtgaaagaaagttttcctttgcccacaacagaggcagtttcaatagtgagtaaatcgccgcccacttctgtccaagctaaaccagttacttcgccaatacggttttgcgtgtcagctttaccaaattcaaaacgttttacgccaagataatcgtgcagattatctgaatttaccgtgatagatttaagttttggatttactaataaatttttcacggctttacggcagatttttgaaatttcacgttctaatccacgtacgcccgcttcacgtgtgtaatagcggataatatctaaaattgcactttcttttacggtaagttcgcctttcttcaaaccattacgttcaatttgttttgctaataaatggcgcattgcgatattaagtttttcatcttctgtataaccagaaagacgaataacttccatacgatccaataatgggcctggaatattcatagagtttgatgttgccacaaacatcacatcagaaagatcataatccacttctaaatagtgatcgttaaacgtggtgttttgctcgggatctaatacttcaagcaacgctgatgcaggatcacctcgcatatcggatgccattttgtcgatttcatcaagcaagaataatggattttttacgcccacttttgccatcttttgaattaatttacctggcaatgcaccaatataggttttacggtgaccacggatttctgcttcatcacgcacgccgcctaatgccatacgtacatatttacgaccagtagcattggcaatagactgaccaagagaagttttacctacacctggagggccaactaaacaaagaatcgggcctttcactttgtttaaacgcgcttgtactgctaaatattcaagaatgcgttcttttacgcgatctaaaccatagtgatcggtatctaaaacttgctgtgctttaacaatgtcttttttcactttagaacgttgatgccaaggcacttggatcatccattcaatataactgcgtattaccgttgcttcagaagacatggcagacatcattttaagtttttgtaattcattttctactttgtcacgcacatcagctggcatgcctgccgcttccaccttttgatgcagttgttcaacttcatcaatggtatcttcattttcgccaccatccatttctttacgaatggctttaatttgctcgttcaaataatagttacgctggcttttctccatttgtttttttacacgaccgcgaatccgtttttccacttggagaatatcagcctctgattccatcataccaagcaaatattctaaacgttcttgcacattagcgagttctaacgcattttgtttatggcgaatgcttacagggagatgggcagccattgtgtcagctaagcgatcaacatcatcaatacgttgaagggcattgagaatatctgtaggcacttttttgttgagggtaagataattttcaaactcagaaagtaccgcacttttttgccaccactaattctgtncagggtaccgagtccgaatacgtatacca

SEQ ID NO: 562 - DNA, 13466 bp, H. influenzae
  misc_feature (2643)..(2643): n = a, c, g, or t
  misc_feature (13138)..(13138): n = a, c, g, or t
  misc_feature (13192)..(13192): n = a, c, g, or t
agccaataatgcagacagcctaaaagccaatccgcaaacgctttcattccaaattcacggcaatcaattgttgcaggaaacgcaatttacagccgatgaaaatgatgaaaccgccccgacaaatcggcacacaaaataattttactcaaaccataaaaatgagtgaaatggagcggcacatttttaataaagccttgcatatcaaaggaaaaaatagtcaatctttatttcatttcgatcgcttgcaaagcaaactcaacattcaaaatcgcaatgaattgcaaaataacttgttaaaagattggcaaattgaatttttgggattagggcaagataaacagattagcccagatgacaacttgcaggctgcctaaaaatcttggaaatggttgaaaaacgtctcaatgaaagtgatatgccatttatcggtacaaaagaatttacgcctaaaaaattgtgggaaatttttggcacaccaaaacaaaaatgggtcaaaaaagatgatgtaaaaactgctattgccatgcaaaatgattggtatgtgatggataattttgctggaacgagtttggaagaagcgttaattcaatttatttcagagcgtttgggcgatttgaaatctaaatatgacgttcatttaatccgcaatgaagaagtgtttaaattgaataactttgccgatggtgaaggatttatgccggactttgttttattgctgaaagataaacaaaaatcttcttccaatggtgtgaacgactttttgcattaccaaattttcattgaacccaaaggcgaacatttagtggaaactgataggtggaaagaagcttttttaaaatcaatcacagtggaatatgggaaggataagatcctgcaaaaagatacaccgcattatcgtttgatcggtttgccgttttttactgatcatcagaaaaatggacaatttacggagttattccctttaggagagacatagcttgaaaaatagagtggtgtattattaaaacacagccttaacaaaacaagggagcattaaaaaatgctccctttctcttaatcaacttaactttatggaatgacgagtaattaacctttctgtacgctatatgcttctaatgcacgtaaagaataagtataagctgcacctgcatttaatgcgatagctgttgctaatgcagcagcaacctcagcttcacttgcaccagcttttactgcttcttctgcgtgtacgctaatgcagctttcacaacgagttgttacagcaactgctaatgcgataagttcgcgagttttagcgtcaagcacattgccctcttccgcggctgagcctaatgcttggtaagcttgtaacattttagggtgttgtttacccaatgcgccaaatgattttttaacgtgagatgtgtgttctttccaatctgcaaacataatgttctcctaaatatattgaattaataaccaactggtgtggcaaattataggcggattagattatgatacttgcttatttatctcaatttttatcgctaacatctcattatggactatttagataaacttacccatttagcacaagtgcgtggagaaattaatattcgctgtgaatttcaaggcgaatggcaaatatctcatcaagaaaaggatgcaggaaaaggcatattccatcttattgaacaaggcgagtgccagcttacactaaatgaaaaacaatttcatttaaaagagggagatattttttttcttcctcaaaatcaaccgcactttatgcattattcagtaaataaaagggcagatattcctacaaaaaaaagtcatcaaggattatttgagttacatcagattggacgaggtacaccagatttaaaaatgttctgcggtaatttttattatcaacaagatgcacttcttacggcatcaatgcctgaatatttacatataaatttatgcgacacgcccattcatcctttagtgcagctttttttgcaagaagcacaaaaaaatgatgcgggtacgaaatcggtcgttgatgcactttcaaatgtacttttaatttatattttacgtcacgccattcaacaaaatttaattgaacaaggcatcttattcgccttacaagataagcgattaaatactgcactgatagcaatattacaacaacctcaaaatgattggcatattgaacaattagctgaacttgcaacaatgtctcgtgcaaactttattcgtgtttttcaacaacaacttggtatgtcgccaggacgttttctcacgaaagtgcggttacaatctgcggcgtttttattaaaacaatcacaacaatctgtgcttgccattgctttagaagtggggtatcaatcagaagcgcatttttgtaaagtttttaaaaattactaccaactttctccaagccaatacagaaaatctgtcagcctataaattgatttgtttttgtgctataataatatgcacttctaaaaggcaacccgcgttgccttttctttttaaggaaaagatatgtttaacaaaattttttcgtggtttgaaaatcgtttgaatccctatccagaaagcaatccaacaacacctaaaaaggtttgttccgttttatttggtctagtattacaggaatgaaaggctggattnttttgctcgcaattttaaccgtaggtacaggtgtaatggaagctgtattattccaatttatgggaacgcttgtagattggttaggcacatttacacctgaaagattatggcaagaaaaaagtcatttattaattggaatggctgctctattacttattagtattgtgtggggatttttagcttcggccgtgcatttacaaaccttacaaggcgtatttccaatgcgattacgttggaatttccatcgtttaatgcttggacaaagtttaagtttttatcaagacgaatttgcaggtagagtatccgcaaaagtaatgcaaaccgcccttgcagtacgtgacacagtacttacacttgcagatatgttcgtttatgtattgggatattttattacctctggcgtagtgctagtggcattagattcttggttcttattaccatttattacttggattatactcttcggtttgatcctacgaacccctattcctaaactatcaaaaaccgcacaacgacaagctgatgctcgttctttaatgacaggacgcattacagatgcttattctaatattgctacagtaaaattattttctcacggctcacgcgaagctacttatgccaagcgttctatgcaagattttatggtaacagtacacgcccaaatgcgcttagcaacatcactagatacactcacttacgctacaaatattctacttacgttaagtactgcaatacttggtattattttatggaaaaatggtcaagttggcgtgggtgcaatagcaacggcaacggccatggcattacgcgtaaatgggctttctcgctggattatgtgggaatctgcccgtttgtttgagaatatcggaaccgtaaacgacggaatgaatactttaactaaaccccacaccattgtggacaaaccacaagcgtcaccgttacaagtgaaacaaggggaaattaagtttaacgatattacctttgcttacgatccgacaaaaccattactcaatcatttcaatctcactatcaaaccaggggaaaaggttgggttaatcggtcgttctggtgcaggaaaatctacgattgtgaacttattacttcgcttttatgaagcacaacaaggcgaaattaccattgatggacaaaatgtactcaatgtgcaacaagaaagcttacgtcgccaaatcggtttagtcactcaagacacttcgttgctacatcgctctgtacgtgacaatattatttatggtcgcccgaatgctactgatgaagaaatggttttagctgctgaacgagcggaagccgctgatttcatcccatttctcagtgattctcaaggtagaaaaggctatgatgcccatgtgggagaacgcggggtaaaactttctggtggtcagcgtcagagaattgccattgctcgtgtaatgttaaaagacgcaccaattctattgttagatgaagccacaagtgcattggattcagaagtggaagtggcaatacaagaaagtctagataagatgatggaaaataaaactgtgattgccattgcccatcgtttatccaccatcgcagcgatggatcgcctgattgtgcttgataaaggacaaattgtcgaacaaggtacgcacgccgaattactagagctcaatggtctgtacgctaaactttggaatcatcaaagtggcggatttttaagcggaagtgctgaataatattgcgtttatcatatttaattaattgtactgtaatcaagctaattaaaaaattagtctaatttaatagctaaagaaaagtgcggtgaattttcaccgcacttttttgctagatatttagcgtttaattcacgacttcagcagtatatttcagcttgtgaattgcatcgaataattgttggtttgtgacttttggatcttccacaaccgtcactaaaccatctttaatagatgcttttgttgaaataacgccatcaatattacgcagttctttattgactaagtaagcacaaagctggcaattcatttcctttacttttagcacaatttgtttggtttcattcgcatgagcgaaagaaattgcaaacagcgaaagcaaaagtgcggtacataatttcttcatttttattcctaattagctaattctaaaatccaaggtaaaattgttggataggttaagaaaaaaatcatcacgataaatacaatccaatataaaacgataagttttttacgggaaatatatttgctacaaatgatttttttggaaaacatcaacagccaaaatccataggcaaaggcacataatgaaatgataagcataggaatacgcaaataatcatattcgcctaagccaatcaaccaagtggacgacacaccaaatactaaataaattaatggtgcgatgcagcacaaggttgatgccaccgcagcacttagtgcggcggctatggcaacccaaaaggatttattagagttttttagatacgtagtcatatttaaattcttttgggtcaaaggaatttaacggatcgccacctacttctgcatatggatagccgaagttattgattggagccagttctggttgtggatataaatcgaagtcacgggcatgattaaatcccacccagtttgcttcccagttaccaaacaaatattttgctacggcttgtgtatctttatcttcaacagattttttctctgctaaacgcattttggcaacgtctgcggaatcaactggtacccatccaaatcctgcaaggtagaattcagcgcggcagtgctgaccgccacttacgtttacgatgccttgttcatttgcactaccgaaggcaccttttgaatatttgcccattttctctgccgtacctaagcgaataccaaaaatttcacgagcagggatgcctgcagcacgagcaagtgccacaaatacagagttaatatcggtacatttaccttttaacacgccagtggtaagaattttttctacatcgccgtcaccacaacctaatacagaattatcacgttccatattttttacgatccagtggtgaataagttctgctttcttcaatggattagtttctttacctaggattttgtcagcaaattctttcacaatgccatcagttttaatatgtggagtagcttttaagtattcttgtacatccacggaatactgaatatcttttggcggagtataattctctaaagcacctttcaccatcggttcacggtcttttgtttcaatgaccatcgtgacttttaaatcacgtttttgtgcatctttatcccaagtggcaaataaggttttcgctccgtatttattgttttctgttacataggcattcatgtaattaccttcaaagtgaatcgatttcacttgttggtattccccattaaatggtaatggaacccataaattggtttgtccttgcgagccttttggcacaactaaatcataggtttgcgtgaattcgtaaagatgggcgtctgtattgtagtttggaataatggtgtttgcatgagctaacgagccacacgcagaaaacaccgcaaccgcgataagtttcttcatgaaaagatcctctagttaataatagttaaacttaacatattagataaactaatacgccactatgctaacggatttttaaatctatagtcaatttgttattccaaaatttataaaaacatcaacctactaaaataccctataaataatgtacctattaataattagttgatttggctcaagtaaaacttctatacaaagattataattaactcgttttagttattactcgatcttactgtgggggacgatattatgagtaactttaatcaaataagtcgccgagattttgtcaaggcgtcatctgcgggagctgcactggcagtttcaaatcttactttacctttcaatgtaatggctaaagagacacaacacctcaatgaaaatagtcaggaacgtattgtttggagtgcttgtacagtaaactgtggtagccgttgtccattacgaatgcacgtaaaagataaccgaatcacttatgtggaaaccgataatacggggacagaaacatataatcttgatcatcaggttcgtgcttgtctacgtggacgttctatgcgtcgtcgagtgtataacccagaccgtttaaaatatccaatgaaacgtataggtaaacgcggagaaggtaaattcaaacgaatcagttgggatgaggctttaactgaaattgcagacgcattgaaacgcaatatcaaaaaatatggcaatgaatcaatttatttaaactatggtacgggaacactcggtggcacaatggctaaatcttggcctcctgcatccactatgatcgctcgttttatgaattgtattggtggatatttaaaccattatggtgattacagcaccgcacaaattgcagtcggtttagattatacctatggtggtggttgggcattgggaaatggaatggctgacattgaaaacaccaaattaatagtgttattcggtaataatcctgcagaaactcgtatgagtggaggtggtttaacttattgtattgaacaagccaaagctcgttccaatgccaaaatgattattatcgatcctcgttataatgatactggtgcagggcgtgaagatgagtggatcccaattcgtccaggcactgatgcagccctcgtttctgcccttgcttatgtaatgattcaagaaaatctcgtggatcaacctttcttagataaatattgtgttggttatgatgaaaaaacattacctgcggatgcccctaaaaatggtcattataaagcctatattttaggttatggtaatgatggtatcgctaaaaccccagaatgggcggctaaaatcacgggtattccggcggagagaattattaaactcgcacgtgaaattggcagcacaaaacctgcctttatttcccaaggttgggggcctcaacgtcgtagtaatggagaattaatctctcgtgccattgcgatgttgccaatcttaacaggtaatgttggaattcacggcggtaacactggtgcacgtgaaagtgcgtatagcattccatttgtgcggatgccaacgctaaaaaatcctgtgaaagcaagcattccaatgtttttatggacagatgcaattattcgtggcacagaaatgaccgcacttacagatggtattcgtggtgttgataaattatcgtcccccaattaaagtaatttggaattacgcaagtaactgtttgattaatcaacacgcacaaatcaatcgtactcacgatattttacaagatgatacccaatgtgaaatgatcattactattgataatcatatgacatctactgccaaatacagtgatattttattaccagattgtacaacttcagaacaaatggatttcgctttagatgcctttgtatccaatatggcctatgtcatttttgcagatcaagtgatcaaaccatcttttgaatgtagacctatttacgatatgttgagtgatttagctgagaaaatgggcgtaaaagaaaaatttactgaaggaagaacacaagaggaatggttacgccatatttatgagcaatctcgagaaaaattacctgaattacctacttttgaagaatttagacaacaaggtatttttaaaaaggttgatcctaatggctttaaagttgcatacaaagatttccgtgataatccagaagcccatccacttaaaacgccatctggcaaaattgaaatttattcttctcgtctagctgaaatagcaaacacttggaaattagcagaagatgaaataattcatcctttaccaattcacgcccaaagttttgagcattacggcgatccattaatggaaaaatatccgctacaactaagtggttttcactacaaagcaagaacccattcaacttatggcaatgtggatgtattaaaagcagctaatccacaagaagtttggatgaatcctattgatgcagaacctcgtaatattaaaaatggcgatatgattcgtatctttaatgatcgaggcgaagtacgtattaatgtaaaaattaccccccgtattattccaggggttgtggcattaagcgagggggcttggtatgcaccagataaagatcgtatcgatcattcaggttgcattaatgtacttacgacacaacgcccatcaccgcttgcgaaaggtaatccgcaacattctaatttagttcaagtggaacgtttgtagggggataattatggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtgtaagatgaatacaggattatatgaactgccactagtattttttacagttttggcacaaagtgcggtcggtgcttggcttgttttcacatttgtactattaaatgagaaaaatacaaaaagtcgcacttatattcataaagtaatgtttgtgattttggctttgctaggtattggatttattgcttccattatgcatcttggcttacctatacgtgcatttaattcacttaatagagtcggctcatcaatgatgagtaatgaaattgccactggtgcaatatttttcgcattagcaggtttctactggctgattgcaattttaggtaaaatgccagcttcacttggaaatgtatggcgaattgtgaccgcccttatcggcatactatttatgtatgtaatgaatcaggtttaccatattacaagcataccaacttggaataatgcattaacctcttggtcattctatcttaccgttgtattaggtggattaacattaagctatgcgttattaatccctaataaacaacgtgaatatcagcttcagcatctgccaagtttatttgccattggagtattattggtcgcaatagtagccatatatcaaggcttcaatttacacaatattcacagtgctattcaaaatgccgctgacctcgtaccaaattatgccataatgaccgtaactcgcttatgtttactttccattgtagctttcctcttattccgagtgaaaaacataggactattaggtatttccgttctattaacgttagtagctgaaggcatcggtcgcgtattattttatggattacatatgacttacggcatggcgattggtggttaaattatgttgaggcgtatagcatacgcctcaatttttagaaacgttaattagtaatatttaaccaaccctcatatccccattcactaatgacaaattgttttcggagatactatgcaaaatactcttcaacaaatttctatttatgggcgtttactcggtgcagtattttactatgagcctaatgatgcacgacttactgatattttgacattctttcgccaaccaaattggatgcaagaatgggaaatttcatttgatgtaaaaacacataaaaaaattaccgcacttattgaaaaagggctgcaacaaaatatcaatgaacaatatcagtatttatttattggtccaaatgaattacctacgccaccttggggatccgtatatcttgatcctgaatgtgttatttttggtaattctctcttagcattacgcgatttcttacaacaacatcaaatcgcatttcaaacacaacaagatgaaccagaagatcatattggcttaatgttaatgcttgctgcatatttagcagaaaatcgaccgcacttattaatcgaatttctacgtgaacacttcttaacttgggcgtatcatttccttgaacaactaagcaaaatagaaaattctgatttttatcaagctcttgcattacttaccctaaaaactttacaacaatggcaagtagatttacatattaatataccgacagtaagattttatcgataatgaaaaacgaagcctattatcaggcttatttaagccaccatcacatttctcgtagaggactattgcgtcatatatttccagctacaaaatcaacaatagaaaaaacgcaatctcgtcctcccttttcagcacgagaagatttattttccgccgtctgcaatggttgtggggaatgtgcttcagcttgccctaatggtttaattcaactaaaacagcaacaagccacccttgaaattgactacgcaccttgtgatttgtgtggtaaatgcgcagaagtttgtccgacaaatgcactacatcctaattttccagcggatacattacttcgtccacaattttcctcagcctgtttaatcctacaaaatcaaacctgtccagactgccaaaccgcttgcacacaacaagcaatctccagcactttagagattgataatgaacgttgcaatgggtgcggagaatgtaaaattacctgttttgtcgcagccattacacttaaataaaaatcttgaggctgtactagataacgactaaaaatcccatttaggttagaataaaccaatgagaaaaagtcgcggtattctggcttctcaaacgaaatggcaaggtttataccgtcgttgtccctaatgcgcaatcagcgacattattgtcaattatccgaggaaaagttaagcctgatagcattgtgtacacggatacctttcgtagttatgatgtgcttgatgtcaatgaatttagccattttcggcatcaatcacaggtcgcattgatgaagaccaagctcaagattatgccaaacgtaaaggttgggatgagagagagatgttgaagtggttgggggggggcgatgaagtagggataaaacatattatgatataacgttatcttatatttgaagttatttattaaactatacaattagagcctaggaataaaaacttaaactatttattaacttaatttattatgggagaaaattttatgtccttaaataattcgctaacaacttttaatagtcagttacccgatttatcagttaatactattcccgcaattaatcaactagtttctgctcttcgcattccaagagacgttttagcaagtgatgaagaaattagatatgcttggaatgatttacctagagaattaagaaatataccagtccagaatgtgaatcctgagcttattgctcgtatgtgcattgcaattagctcaggattatttgatggtgcaatcaactatatatggaatgcttctattttgagattgcgtgataaagttagaacctttggtcttccaattgttgctcaagtattggaaagggattttgaagaaggccatttaatagcattacaggatagtcagttactagatttatgtttgcaattaaacattcttaacgaagaaggctttctttttctaggccaatgtagaaatatccgtaataatttttctgctgctcacccttcacttggcaatttgaatgatagagaattcattacattcttaaatcgttgtataaaatatgctttaggtgattcttcttcacctaaaggagtcaatattagtgattttattcaatcgattaaaggtggaagatttaatcaagaacaaagggaatattggattgataggctatctaaaactcacgaagcacagaaacaattattgattattatggcacacggtatttattgtgacccaaactcacaggaaacaactagattaaatgctttagatatttgtgctttctttcaaaatagtttttctgcttcactaaaatcttcattaattgataaacactctgaatatatcgcaaaaggagatgaacaaagattaagagcatctagtcaattttttgagaaattaagtttattagggttgctatcagctccacaacaacatgcgattttttcagcagcaattaacaggttgcaaatcgctcatgatgggctaaacaatttttataatgagcctccctatgctgaaagattagcagaattgtctaaaatacagcagtccctgaaacagccaagggattttgagaacgatagtntctgttatttggaaacaatatgggagttcatggggagcattccattttatgaanaaatattagaaacttttctccaaagaattaacctatgattaccatgcaaaattatagttctaaaatggaagaaaaccacgatgatatggagataagattattgaagctttaaaataatgattcgggagattccaaggggagtcccccagatatgccaattataatatatgggggggtgttactacaaccttcagactgccccccaaggcgactcttcccggggggcctaattataaacccctcaaaccaccgctttattttaggcccggtggga

SEQ ID NO: 563 - DNA, 14710 bp, H. influenzae
  misc_feature (8250)..(8250): n = a, c, g, or t
  misc_feature (8293)..(8293): n = a, c, g, or t
  misc_feature (8350)..(8350): n = a, c, g, or t
taactgcacgtctggtcgtcggctgtaaagtcataaggcggtaatgggctccacgaacaagattatgattggattaattgtatgacgcgtcttaaaattggcggataaaaagggtcaagtgttgattatgatttgaaagcctggcatttatcgatatgcaccaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaacccaatccccctctttagtaaagaggggttaggggagatttggcagaagtaacatcaacctcagtggtgaattttatatcgttaaaatctcctccagaccctcttcacaaaagatgagagaaaattaaccgcacttttgcagtaaaaaataggaaaaataatatgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaatacttgccttcctccgtttacgggggaaaggtgcccgaagggcggaaggggggcaatctcccacccttagttatttagaaatatccccaataaacagggggacaaagtatttaaagtgcggctgaaaaacacgtcgaattttaaccgcacttcccttaacgaatagagaaaaacattatggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaaggctcaataagaggaaaaagaaaaatggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaaaaataaaaaatgtgctgatttttcaccgcacttaatcactgaatttcattcaaaaataaagccctgtaatacacagggctttgtcgtttataacgctaattcaaacaggctgattaaaaactaaaacttagtttcacttctgcagttttttgtttttccgcttgttttgcttttgttaatccgccaattagacttaatttcacattatgatatttcaatttaagtcctgcgttatattgctgttggttttccacattgtaagcaaaatcatatctatctacattaattttgccgctgccttgatttgcatcatatcgagcagacaaaattggcgtaatggaaaactcgcctaagtgataagtataacttaaatcaacttgagcaaaggctgttttgacagatattggatttactttaatgcgatctttagctaatgcaaaattagcgtttgataagtaactataacgaacccctacagttggtttaacagcaaaattgccaagattaaatgctttgcctgcggttaaaccaaattgtgcagtatggcgagcaaatttcgcattatgattagtttgtaagttgctttggaaattaccatagcctaaatccaccgctaaataccaatgattatccatataatatttagaatagagatttgcttgtgctaaggtatttttactgcttgccttatcaaagttgttactattgcgaacataagtaaacacaccacctaactgaacattgcttgagattgtttgatcccaaccaagttgagtttgcgcacttttagaactaaaatgacgatattgacttgaggaataattttctttcattgaagtattagatacccaaacgttatattgcccctcgttattcatttctaactggctaatatgttgagaaacggctttccctacatttaatgcaacaaattgtgcttttgccatggcatcagaaattaccgcattggtgtttgtacttgtgagatcgcgcaatactagttgtgtagccacatcatttcccgattgcggattctccgcattttcagtatgtagttccactggctcgtaactattctgagctgatctacgagttcttctgcttcgtggttgtggagtagatcctgaattatccactgttgtttcttgagtagaagctactgttgtttcttcagcagaagtcactttagactggctaacaacagcttctgttgtcgctgtttctgattgaactgcctctgaattaaccgtagattgagttgtagcaggtgttgtattctctggatttttcactacagggttttcagtgcttactgttgtggtttctgtcacaggttgttcagcttctgtagttttattctcaacaggtttaataggtgttgtagcattttcaggtgtaacaacttctgttgaagcaacagcagtgtgggcttcaggctgatgaatattttcatctgtcgtttctgttgattgaggattttctgctttattttcagctgtttttggattagctacaggttgagcagtttctttctgttcactgtttgatgcagttgtctctttcgcagcaacagttgtaggttttgcttgcggttgagcttcttttacattattaacagtcgaaacattttcacgagcaggctctgcttgctgtgtggtagtttctggctgtgcttgcgattgaacagttttaggctgttcttgctgtttagccatttctggttcttcttgttttggagacgcttgaaaagccacttgaggggcttcttgagttttctctgtttctactttagcagtatcttctgttcctgctagatttatattattagaagacgagctaatacttcttctaggtctgctctttggttcactgattgtaggatcatcttctactactgtttcttcagtagaatttatttcagactgacgagcagtttcagcctcttgagtttcctcggtttcgcttccattttgggcgagttcatttgtttgagtgttagcttccacagttggtttagcttcttttgcaacttcatcattttgagctgttgtctcggttgctttttgctcgtttttcgctactgtttcactttcttgcggactattttcagccactttttcaattgtctctgatggaacactttctgaatttggatcatcagcctgtgttgtatcagcttgtggttcagatcccgatgggtgagtagtatttgtatcttccattgtaggttgaacggtttctgcaggacgagtttctggttgctcgtttgccattgctgatccagtagcaggtgcaggtggtgctggcagtggaattggtgcttcaacacgagcggtttcttcatggttatttgatacgctaggtacatcagcttgcatattattagctgttgcaatacttggcgtatcgacagtttgatttcttctttctacttctgggttatgcaagtaataacgtccactattttctttcaaagtatagctccaagcacctcgatcaactttgccattagccagtgaaacatttaagccacttctttcagttgcatttgacgcatcaaaaagcgtaagttcattatgatttggctcgcctgttttatttgccacttgtaatgtaaaggtacctttggctgatttggttacaacaactttgtcgccctgatttttggtaaaatcaacccaataatagaaagaaccattacctgataaattgctaatattgagcgtgtggtattttgtttcttttgttgcatctgagacattatttaaatgaatatgcccatttgctagatctaattgatgaacatcactatttcctgttaaataccaatggctgttttcttttaaattaacttggctattttccgtgctgttaattgtgccaaataagttagctttgcctaaggtaaagtttgcactttcggttaaatttacattaccgcgcaaattagttggattaaaactattgagtgcttttgtagataaagtgtcattatggcaagtcacatagcccgtatagtcagaacgtacacaaacggtatcgcctgctttatagccgatatgcacttttgctttattagaggctgtgatatttgaagtaatactttcaacattgcgacctgaataaagggttgcgttattggttacattaatatttgttgctttaaaagtgcggttaatccagtcgtcttctaccaccacttcattattttcagcaaagtgtttatctttttctgttgaagaaatatttgcaatatctcttgcgtgtggtgttggtctgccagaaaggaataatgtacctttttcaacttttaattcaccgttaaggtttgttccgccagtcaataaaaagcgattttgatcacttttgccactaaaggtaacatttaatttaccgttttgatctgccttagttgcttcctcgccaaaataaccattaaagccattcatacgtctgttattgatgtacaccatggctttcttttgtgcatcattttgattgtcgcccatgaattcccaattagcatctgatttttcagagctatagcaaggcatttctgcagtagggcttccaccttgctttaacgcatagtatttataacaggtattactaaagtaaagatcttttcctcttggaatagatggcacatagtaataattatcatcatcggcggttattgctggtgtatatatagtgacctgacttggatttgtaattaatcctgctccagtaatcgttatatttgaggcattagtcatattatgattaactagtcttgcaccatcatcaatattacggatatgttcaaaagtgagattattgccattggcatctaatcgaccgcctctaaaaccaaagtaaattgaatttggatctacttggttatcatcattaagtacaacagttgagcgaccacttacaattcctacagaagcaaaagcgtgttgtcctgtagttgtttgttgttttaaaacaactgtgccatcgcccacttttagcgaacctttattatctcctcttccttcaacaattagctttcctttaccaattttagctaaacgatcaaattgagggttatgcactttccactttactgtttttccttcagcaacagatataccagcccctttccaagtcgtattttctgaagtgcctttaacttcataatcaccttcaaagaacaatccgcctgcaccttgatcgatattattatttaagggtaggtttccacttccttcanacgtaacatttttcccatgattgagatttttattatccactanatcaacacttaatgattcagatgttccagatatcaagcttgtattacctttgcttgnccagttatattgcgtattacctttcagtaaaccagcactgtcttttttgagaatattttcagcaaattgtggtttataaatattccattcttgccaagattttttcttataccctccccaaaaatcataagcaccaaggaaaagccatttctctttagatttatcataaacaaataacggtgagccactatctcccaagacagcataattagtaagcggtttacgagataatatctcttttggatcgttatgatcttcggttgaatcaccaaacccaatgagtccatcgtctgtatgattcactttataaggcgtgcctgcaataccataggtataagcgttaccaactaatttaagattatctccacctacatcccatctgtgtattatttcctttttctcgtttttctcttctaaaattaattcataatggcttccttttttatagataaattgagagccacttcctaatctcacaaaagcaggatatttattctgatcattatatgttccagcatcactacttgtagttgaagcctctatcggtgcaacttcggtaacaaatttatcaaggcgtggcatataataatcttcacggcgtttttggttttgctgttctttaactaaggcttgtccatataattcggaaggaacatcttttttattagatgtatactgtttatctttttcgttattttgtgtttttccgtttaattcagaagaaaaattatttttttcaacagtgtaatatctgttttcctcccaagatacatctcgatgctgaatagaatttccaaatttagggttccaattcccatttaaattcccaaaatgtagttcacccacaccgttaccaacgtgttttacccccacaacatattgtggatttaccaacgtggcaattctcttatctacatccacagcactaaaatcaatcatcggaatatctttaggtagcgcactgcccaaattattatttttgttatctctcacttccacatttgttgcaccaacagaaaacttccctttattctctgcaaaatcacgaaatatttgataatccacatcgtttctcactaacgcggcttctgtataaggggttaatgcgtaggcgacagtaagcgcaataaaattgagtttgaattttttatttagcatagaagctgtccttattaattaagtttaaaaagtagatttgatatacagctacaagttgattcaaatcttggctgtgttgcgttgatagtttgcaagttgtcttcatttttataatgagtgggttttatagcataaatcgctcaaaacttgaattacatttattaggtaatgataatgatttttgatattttttaaaaaattggcgtattttttaccgcacttttggttaatttaaggcgttaatgatgccattatggacagaaaacatttttttgttttccacttgcatttcttttagttgtctttgagtgatggcggtaacaaatacttgcgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatacacacattaaaagtttaagctgtccacgagaaagcacatcttcaacaggcaatccttgtgctttgaaacgaaaatccgctttttgagggccagaaaaggtgtaatttaaggcacgatctcgttcaaaattttgttgaagaatttcataataatcagcatttttttcccacccttgatgaaagctgacattaatttctaattcaggcagaaaaagttggcaagtttgttcaatttcagggcggagagcttctgcatattcggcacgccattgacttacttggtgggcaagtttggcaagttcaacgtcccaaatttttatggcagagtaaggctgattttgtgcgagtgcggcatttcgttgtttaagtaatcggttgagattgctccaagcggaatagaaacttgtttggtggtggaataatccccaatctaaaaacgcacgacgataacttggcccaccgttgagtaaggttaagccctctggcgtgattaattgcattggtaaaagatgggctagatcggaaattttattgccatcttcgccgttaatttttactaaggtgttgccttgacgaagtttttgtaagccgacagaccattgatgttggctttcttggatttgtccaaatagggtaaagtgcggttcgtcgtaagaaatgatgcggtttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcgcattcgcacttgattacatttaagtgcattcagcacatcaagaatataggtgacattaaagcccacttctaattcttcgccattgtaattgacatcgacaatttcttctgcttcttcgtgttctgtgtttgaggcagtaattttaagctggttttcctttaagcttaaacgcacgctgcgcgctcgttcattagataaaatggacgcacgaacaaaagcctgtttcagcatttcccaattgccttcgacagtttttgtggcattacgaggcaatactcggcgatagtcaggaaagcgaccatcaattaattttgatgtaaataccgtgttttttaaatggacacgtaaattgttggtgccaatttgtaaacgcgctggttcatcgtttgtttctaataaacgaaccagctctaacacacctttacgcggtaaaatcacagaatgattttgtaattcttgttcaagggaaatggtacacaccgcaagtctatgaccatctgttgccaccgttcgcaataaattgccttctgtttcaaacttcataccatttaagaaatagcgcgcatcttggtttgccatagaaaattgagtggcttcaattaaacggcgtaaggtattttgcggtagttgaaaatccacttcagactgccaatccgtgaggtttggatattcttcggcaggttgggttgtcagcgtaaaacggctacgcccagactgcactaaagcacggtcttgttcaaaagtcaccgtgatttctgaatcatcagataaagtgcggcaaatatctaagaatttttttgctggaatggtaaaagtgccattttcagaagacgatgaaagctgagtttgactcgataattcgacttctaaatctgtaccagtgatagtcagacgattgtcttcaatttgcaacaatacgttgtttaatacaggaatatttggacgattactcaatacgccacatacttgttgcaacggttttaataaattttctcttgaaatgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtctagcgaaaagttctttgctgttttatatctttttcaattttagattatgcggacaaagtgcggattaaattcgcccaatcttcttgaatgctattgtcttgctcgcggaattttggcacttcacggcaagcgtttaatacggttgtgtgatcacggtcaaaggcacgaccgatttcaggcaaactgcggtttgttaattcttttgctaacgccatggcaatttggcgagggcgagtgactgaacgcgcacgactttttgattttaaatctgaaaccttaattcgataatattcagccaccactttttgaatattttcaatagtaaccaagcgttcttgtaaagccaaaatatcttttaaggtatcacgcacgaaatcaatatcaatgtcaccgcctttgaagtcttgcattgctttcactcgatttaatgcaccctcaagttcacgcacgttggtacgcaagcgttgagcaatgaagaaagcaacttcttctggcaagttcatattatgttcttccgcctttttcaataaaatcgctacgcgagtttcaagatcgggcggttcaatggctgttgttaagccccagccaaaacgtgattttaaacgttcttcaattttttcaatttctttagggtaacgatccgaagttaagataatttggcgacccgtttcaaataagttattgaatatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgcgcattcggtttatcggctaaaatgccgttgccaatggcgtgtaacaagtgagttttccctaaaccagtgccgccatataaaaagaaaggattagccgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatatatttggcgtattttctactactttaggtgcaggcttgaccccttcttttaaagaaatacgcagttcaggattttgtgtaagtgtttgacaaatttgctggatttgtgcgagataatgggtttccacccaacctttcacaaacatattagaagcatataaaacaatgtggttatccgccaccacatcagcctgtaaaggacgaagccaagtgctaagatcgctggctgaaacttgatcttgaagttgtaacaggcaactttgccaaagatttgagagattcacaaaaggatccttgttgtttttattataaaagtgcggtcaaaattgtcggagattttacaataaatgtgtgaaaagatcttctaaaaaatctagtgttgagttttcatttcataagattatagaactgaaaagaaatgcgccagtgcgatatagatagcgtgcttaacctgtctggcgcattttaatttagaatttcatttctaatgttaaggtatagtttcgtcctgatgctgcgtagcgagtataattaccaacattttgatgttgattgaccgctccttgtgctgtttgacgcaccgcttcccaagtgacatagcgatagtttaataaattatatactcctaatcggaacaaaatacttctattcaccatgtaataacccgatacatctaagatatgccatgcccgagtaagttttcttgttgattttacaccccttgaagtgttacctaatgaacgttgtcctagcaattcattttgagattttgcttttgattgagtaaacattgtattaattccccgaagtattacttgaatgatcatagcctaaaccaatgatataacggctgggctgaatggcatcaaataaatagctgcttacggaggctaaaccagcattgattctttgatctttaacttttactcggttataagcaaatgttgcataccatccgtagggaatacgtttccataaaccattaaaatctaattgcgcagttatatttacgccaactaattttgcattttgtgcattatgatatccataattgcccttgccctttccatttttaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccatccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataatatttttcccttaataaccgcacttacagtcatgggtacgagccgaatcgaac

SEQ ID NO: 564 - DNA, 12186 bp, H. influenzae
  misc_feature (12116)..(12116): n = a, c, g, or t
aggatccccttttatggttgatcatgataccttattcgggacaaagaaagaaaattcattcaacaacgaatgaaagatattcgtaaacgtattgatgattttattcaattaggtaataaaaaataaaagggcgaaagcccttttttgttgcacattgtagaaaatagttttatatttcttcaaaaagttgtaaacttcgcaaacttttattctttggtgacttatgacaaatctatcattaaatcctatttttgaaagttttgcgccaatttttaagcaattaaaaaccgtggcaatgtctgcgttatttattgcgccattggcgataaatcatcctgttcgtcacactacacacacagtcaatattttcagtgttcaaacagatgaaaataaatcgatcaatcaacaagacatagaaaagattattgatatggtgaaagctgtttctgctatcactgattttgttattgcgtcaattacggcagaatcattaagctatattgatttaagtgacgttctgagactagaaagcaaaattaataaatatgatgatctagctaacaatattatggtcaataataaaactccagaattatcaacaacgctacaatcattcagcaataaaatgcacacgctttgcaatatgatgaaatcagaaaaatacaagcaacaatcagatgaagtagtgttatcacgcctttatcgcaaatctgaagatgcagggtacacctacaaatcatcacattcttttgatgattttaaaaaagcagtgatgatgtaggataacaaatgaagattgagttatcgaaacaatttcaagaagggcgtttaaacacgcccttttttaaagacattcaagccatgtcagatgaagaattgcagctcatctttgattttatgcaatccattaaacaagggaaactattaagaggtaaaaataaaccatcttggcttgatgataatctcaatgacattccaaatacagaggtttatcaacaaaacgaaatatggcattatcactgcggcccttacaataaaggatctagatattgtcctatgagtgggctaaaaataaatttgaatggagaaacatcaggacctgtaattcattatcaaaaaatatcagatgaacatatcgtgattatcgctttttctccacaacacgaaccgttcccacgcgaatgggacactccaaacccaatcattgacagagcataatcaaagggcgaaagcccttttttgttacctactattccacacactcccacactcgccacaccgcacaatattgccaacaataaggcattttctttaactgtgaatgcctatgtctgctgaattacaacgaaaactagacaacattatccgctttggggtaatcgctgaagtgaatcacgccactgcacgagctcgcgtaaagagcggtgacattctgacggattttttacccttcgttacatttcgagcgggtacaaccaaaacttggtcgccgccgacggtgggcgaacaatgtgtgatgttatccgttagcggtgaatttactactgcctgcatattagttgggctttacacacaaaatagcccaagccaatcgcccgacgaacacgtcattgaatttgctgacggtgccaaaatcacttacaaccaatcaagtggtgcattggttgtgacaggtatcaaaaccgccagtattactgccgctaatcaaattgatattgactgccccgctatcaatatcaaaggtaatgtgaatattgacggctctttatcaaccacaggcacaagcaccacaaaaggcaatatcagcacgcaaggcagcgtgaccgcaagcggtgatattaaaggtggctcaattagtttacaaaaccacgtccaccttgaacaaggcgatggccaacgaacctctaacgcaaaggcatagtatgaatcgatacactggcgaaacattaaaaaacgaaagcgaccacattaaacaatccatcgccgatattttgctaacgccagttggttcacgaattcagcggcgtgaatatggcagtttaatcccaatgctaatagaccgcccaattagccacacattgttattacaactggcggcttgtgccgtcactgcgattaatcgttgggaacctcgagtacagatcacacaatttaaacctgaattggttgaaggtggcattgtggcaagttatgtcgcacgcagtcgtaaagataaccaagaaatgcacaacgaaaaactatttttaggacataaacaatgagcgaattagtcgatttatcaaaactagatgcaccaaaagtgctagaagatttagattttgaaagtttgctcgcagacagaaaagcggaatttatcgcacttttcccacaagatgaaagggcattttggcaagcacgattaagtttagaaagtgagcccatcacgaaattattacaagaagtggtttacttacagttgatggaaagaaaccgcatcaacaatgcggcaaaagccacaatgttagcctatgccagcggttcagatttagatgtgattgccgccaattacaatgtgaaaagacaagtcattcaagaggcgaataataatgttacgcctaaaatccccgaaattttagaagatgacacctcattaagattgcgcacgcaattagcctttgaggggctttctgtggcgggtcctcgctctgcttatatcttccacgcactctctgcacaccctgatgttgcagatgtgtctgtggtatcaccacagccagccaatgtcaccgtcacgattttaagccgtaatggacaaggtgaaacaaacgaaaaccttttaaatgtagttagagccaaacttaatgatgatgacattcgccctattggcgaccgcgttattgtccaaagtgcggtgatccaatcctacgaaatccgcgccaaattacatctttatcgtggccctgaatacgagccaatcaaagctgcagctctaaaaaaattgaccacttacaccgaagaaaaacaccgtttagggcgagatattagcctatcgggtatttatgccgcattacacttggaaggtgtacaacgagtagagcttatctcacctaccgccgaccttgtgctaccaagctcaaaatcagcctactgcacggcaattaatttggagatagtgacaagtgatgattactaatcatttactgccgataggcgcaactccattagaaaaacgtgcggcagaaattctaaaaagtgcggtagaaaatcccattgttattgcagatttaatcaaccctgaacgttgtcccaccgaattactgccttatttagcttgggcgttttcagtggataaatgggatgaaaactggacagaagaagttaaacgcattgcgattaaacagtcttattttgtacacaaacacaaaggcacgattggcgcagtaaagcgtgtggttgagccaataggctatcttattgaactgaaagaatggtttcaaacaaatccgcaaggcacaccaggaacatttagcctaaccgtagaagtgtctgaaagtggcttgaatgaacaaacctataacgaactagtgcgactgattaatgatgttaaacccgtctcaagacatctcaatcagctcgctatcgccctctccccaacagggtcactttgtgcctttgttggtcagcaatggggcgaaatcatcacggtatatccacaataggaatatttatggcatcacaatattttgcaatcttaaccgactacggaacacgtgctatcgctcacgcattaagccaagggcaaccgttacagctcacccaatttgcagtgggtgatggcaatgggaaagcggtcacaccaacggcgaacgcaacagctctcgtacatcaaacgcacattgcacctgtcagtgccgtctctctcgaccctcgcaataataaacaagtcatcgttgaattaaccatccctgaaaatatcggcggtttttacataagagaaatgggcgtatttgacgcacaaaacaaactcattgcctacgcaaactgtcctgaaagttttaaaccgacagaaagtagcggaagtggtaaagtccaagtattgcggatgatcttaaaagtagaatcttctagtgcggtgacattatctattgataacagtgtgatttttgtcacccgacaacaaatgacaccaaaaaccattactgccacaacgcaaaatggatttaatgaaagcggacacagccaccaaatagccaaggcaagcaccacacaacaaggtatagtccaactcaccaacgacacagggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagatggaaaggttggtttaaatggtaacgaaagcattaatggcgagaaatcctttgaaaatcgtattgtggcaaaaagaaatatccgtatttcagacagccagcattatgcttcacgcggagactatttaaatatcggggcaaacaatggcgattgctggttcgaatataaatcaagcaaccgagagattggcacgcttcgtatgcacgctaacggcgatttaacctacaaacgccaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacttagcaagcggtcaaaatctacccgaaaatggggaatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatgaaggagtgattaatgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaatgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagttaaaaggagcgtttaccctgcaaaacttcaaagggtataaagatttaaattgcttagcgagttggttattgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattttagctatgaaaaaggcttcgggtgatcacgaagcctttgttttagtcttctaattcggaaagcaagcaataaaacggtggggcgaaaggggcgagcgtggacgtaaatctcaccacgcaatctttgcgtccgtcttccacaaaacgcacatctaaaaatgccgtgttatagacaaaagtttgcccgcattcgttaggcagtgaatattgcgaaccgtctacaataaaaccgtcgtgttctttcactgcaataagggctaattccatcatcatttcctgctcggttctcatttgaaaatttgtcattttgtggtttcctgtgcttgtttaagttggtcacaggattactctcttcggcaggcatagcaagtcatcattgcggcaaaacgactgactgcggtcgaattagactgggggggtatggacggctaaataagtgcagatatgtaatgccatttcactaaatgaaaaaacaagaaaaggaaattatcttgcttttttaggaacggttatgttgtgcgggtttatctaaagtgtaaaatttaaacgccctttaatgatgatttaaagggcgttttgtctagatatatggcattaaatataatggtattatgaatggtattatataattatgtttcttttgaaaatttcgttttaaatcaaaatattatttaattaattctaatccagctagtcgcaccatctctatttttctctattccccaattttcagatagaaatagataaaatataagtaaaaacaatagcttatataatttcacacactaaaacataccttcttttttatatcaaaatcgcctaaaaggtagtatttttataccgattgggatcgatttcgatctgttctatactccattgcacatatttttgcacacgtgtattgcacacatttttatggaataaacaatggcgacaattatcaagaatggcaagcgttggcacgcacaagtgcgcaagtttggcgtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtggtaaaatcaacgattaaaagaagtctctccagcaacagttttgcgtgaacgtagttcgctttctgctctaatggccaaaacgattgaatgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctgtaaccgtccatggagcattaaaaggtcaatttgtgacggttttaatggcgaaccgataggcaacatcaatagattagcttgatgttcaatttttgaacggttacagttattgacacaagtccaagcggctcgatgcgccttgtttgttcggtggtctccgaattaagtgcggtggaacccaacgcacttttcgctgatttaatcacccagttttttaatttggtgatgattttcttttctgtgaatctgttttttacccccacaattttcttacgaatctcaccgtatttattcggttcgcattcttcatactcaatacaaataggctgatcacaacgttttgtcattgcgccaccttgcgcaaactatcactcaacaaatcattttgccgtatttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggttaggcgaaagagatttgaaacgccgtgggattgataagcctgacgacagttctgaatttttggtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaagtaaggctcccgatcacttacacacgctctcggacacctgagcaggacgagccacctcaagtaggctgcggcagggagattatcaccgcttttttaataactgccttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctggtgatataatctcgcggttttttaggagtcgataccatggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatttaatagcagaaagtgagcaaaattgctcacttttttcagtcttaagcccccaattccctcctaattaaatagttcaatttttaatcatttcacacccagatactgggggggtgttcccncccccaagcacgcatctcatatttattgctccccaatatgtttgtctttttcttttcccccactacccgc

SEQ ID NO: 565 - DNA, 12596 bp, H. influenzae
cgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggccggagaattaatagagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacaaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaataaggatttccaatgttaagaatttacgctcctgcatctagcgcgaatattagcgtaggtttcgatactttaggtgctgcgatctctcctattgatggttctttgttaggcgatgtggttcaaatagaatctatttcaagtggttttgagttagaaagtgcgggctattttgttcgtaaattaccgaaagaaccacaaaaaaatattgtttaccaagcttatgtgctatttagcgagcaattaaaattacgcggagcaaatgttaaacctttacgtttaacgctcgaaaaaaatatgcctattggctctggtttaggctctagtgcttgttctattgttgctgcattagtggcattaaatcagtttcataatgaacctttttcgaaaatggaattgcttgaaatgatgggagaattggaaggtcgtatttctggttcaatccattatgataacgtcgcaccttgctatcttggcggtgtgcaatttatggtgcaatcgctcggcaatatttgtcaaaaattgccattttttgataattggtattgggtgttagcctatccagggattgaagtttctactgctgaagctcgtgcaattttaccgaaaagctatactcgacaaaacgtgattgcccatggtcgtcatttaggtggctttgtgcatgcttgccatacccatcaggaaaatcttgccgcgattatgatgaaagatgtcattgccgagccttatcgtgaatctctgttacctaattttgctgaagtaaaacaagctactcgagacttaggcgcacttgccacaggtatttcaggctcagggccaactattttctctattgcccctgatttacaaactgcaattaaactttcaagttatttagaaagccattatttacaaaataatgaaggttttgtgcatgtatgtaaagttgataacgaaggcacaagagaaattaaataagttaatttaaatagatgaaatcagattaaaaacggattaaatatgaatttatacaatatcaaacacccagaagaacaagtcactttttctcaggctgttcgtcaaggtcttgggtgggatcaaggtctattctttccagaagttattcctaaacttaataacattaatgaattacttgaattgcctcttgttgagcgtagtcaaaaaattctaggtgcattaattgatggcgagttaccacaagcaacgttagatgcaatggtaaaaaatgcgtttactttcactgcaccgttagaaaaagtggaagataatatttatgcacttgaattatttcacggtccaacgctagcatttaaagattttggtgggcgttttatggcacaggcacttgctgcggtacgtggcgatggcaaaattactattttaacggcaacctcaggcgatactggagccgctgtagcacatgcgttttatggattagaaaatattaatgtagttatcctttatccaaaaggcaaaattagcccattacaagaaaagctattctgtactttaggtgggaatattcgtactgttgcgattaacgctgatttcgatgcgtgtcaggctttggttaagcaagcctttgatgatgttgaattgcgccaagctatcgggctgaactctgcaaattctattaatatcagccgtttattagctcaagtttgttattactttgaggctgtcgcacaattgccaaaagaaaaacgtgataatgtcgtggtttctgtgccaagtggtaattttggtaacttaacggcgggattaattgcaaaaaccttaggcttgccgataaaacgctttgtcgcctcaacaaacgcaaatgatactgtgccacgttatttgaaatcgggtaattgggatcctaaaacgacagttgcaaccctttctaatgcaatggatgtaagtcgcccaaacaattggccgagagtggaagaattgtttaaacgaaatggttgggatttaactgatttaggttcggggatgctaagtgatagcgaaacagaagataccttaaaagcgatgcagtcgaaaggttatttatgtgaacctcacggtgcgatagcttatcaggtgttgaaagagcaacttaaagcgagtgaaacaggaatcttcttgtgtacggcgcatcctgcgaaatttaaagaatccgtagaacgtattcttggtattcagcttccattacctgaaacactggataaacataatcagctaccattgctttcagatgaaatggataatgattttgcacaactacgggcttacttattgaagtcataaagtgcggtaaatttttattgtgttttggatagcatctgattttcaggtgctattttatttttagaaaatagggtatagagataaaaaaataaggatatattaactaattaattttacattaatagaaagaatagctatttatcaataagacagtgatttgaaaaagtagtattaaatttaggcaataaaaaaataccttttcggtgattactttatttttaagtggtgggtcgtgaaggattcgaaccttcgaccaacggattaaaagtccgctgctctaccgactgagctaacgacccaattagatgattttaaagtaaattttaaaatctttggattggtattttaaatggtgcccgaagccagacttgaactggcacgcctcgaaaggcgagggattttaaatcccttgtgtacatcatttaagtttgaaaactatttgtttagaccaattccgtgtacctagccaatacaccatgatctacccactaacgctctgtggataggttagatcttacacaaaaatactagtttgtaaagcctgaatgtattaattttaaaaatatttttataaggatgaataagctgagaatgagcggtttaaatttattttgcaaggaacacccttagatgctccttgcatacctatctaaagtaattctgtatattctcttattgaatcaatattatcttcaatataactcaatgtaactttgacatctttatgtcctagtaattgtttggctatatataggttttcaggttttttcattagatttgttgctgctgtatgcctaaatctgtgtggggagctaataattcctgtatattttgaaataactttgaagatatagctcacctggtcattggtcattttctctccctttcgtttaactgcatttgaaaataaattaatgttaaatagttgagattctacaggctgattcaatttacttagttcagttaataatttctttagataaggataaagtgtagttgatataggaagtatatgatactcgtgatttttatttatctcagatggaatatgaataacttgatttagcaaatctacatctttaattcttaatttatttaactgagagcgtcgaattgccgtatagcggaaagtcataattatagttttagtaaaccataatgggcgaagaatagaaggaagatgctttgattcagtaattccaaagctaagtttttttaaatctgaagaagtatatactttccttttcttctttccttctctaatgaacaaaccatcgaaagggttctttgtaaatgggaggagttgtttttcaattccaaatttgaaaatagtctttagctgacgaatatagctgttccaagtcacttcaatgatagattgtccaacaactctctttctccattggagtattaatgagtctgatatttcatcaggatattgaatactacaatttttctgtaattgtctaattgctttttcatagcttttaatagtatctatacgtaaatgacggtataaaaaaaattactaagtaacatatcaaatgtggttctattcactttcattttcctcaataagtgataaatgcaaattatcaattggaattctattaccgaaaaaatagtcggttttatcaatcaaatacccaatcaattgagaggttcttcttgggccaataaccttacagcgccaaaaattaatactatcattgtttgattgacggtatttcttgtgtaatttaaggtcttggaaactatattgcaaattttcgatatcttttttagtaaagttagtaatgcccttactattgaaaaatagctgaaagattccaggtgttacaaggaaaagtttgcctttgactatatgtaatttagcatttgaattattaatagttagggtattcccgataattccagattttagccattcaacaaaaatctctcctgagacagcctcagtttcctttgtatcatcatccgttgctatagatggggtagaggcgattttatttatttcactttcttgagatggttttttatcagtagagtcttgagattcttctacaggtgaaaataaattcattaccaaatcagtcatatccgtctcggtttctgagttttgggtattgatttgagtgttttgagaggatgtattttcagataaatccggtttattcagtgtacctgttattgcaggaagtggcatttcagattccataatcactgaattttcttctttagtatcttcacctgaatttaattgttcttcattttcaatatcgactcgacctaaaaatataccaggtctgtcattaagattttcccaagctacttccggtttaattctgagtaaagaaaatgctttaggtgggcaccagcctgaatcagctttaattcgacaatgccaaattgctgtaccatcatttgtactttcaataatccccagcgattgcatttcactaaataatttaggattgtctgctggagctgatatcccttgctccaataaataagctcgaatttggtctgcagtgggtttgctcattaaccatagcgcatcctctgtaagccaaccatcagatgggcctttaggtgtattaattttaaatttatgttgcagtaaatgacgtaaagccatgactagctgttttgcaaatgatgttataggtttctgagtcagttttgatacgtctccacctagtgcaagagttacactgttttggtctgctttttgtactatttcagataataaaccagctttatctttatgatcagccatggcatacattaaagctgaaaaagcttccgggtattctgctaaccatgcaaatgcttctttaggaattaaatagtttgcaagaaaactacccataaccgggtgaagatcataatctcgccctttaatatatttgaatttataaggttgagttggcactcctaaccaaggaaaccaacgagaaccatcttttaattgtatatctatatcaacaataactttaccaatgtcatgaaccaatgcagcataaataacagcagcagtccaagcatcacgttgcttagattgttcttccggagcagcattttgtggcaatacataactttgtcgtaatttagctgcaaatgaaagaacttctaggccatgatcaagcataccacctaaatgtgagtgatgatgtgattctgaggcaggtagtaattgaaccatttcagcgtagcgctcgataggttttttatagagctcattaaacatatcttgcgtcattgatacttgttgccaaagtaaatttaagtatttttggcgtaattcagaattgagtaattctgacgcagagaacggagttatccatccctcactatcaatctttgacattgaatggttatgggaatctagaactggaatagtaaaggaatcttgttttttcccttttaatcgataaaaaattgatgaaaacataaaaaaataacccataaatttttgcaaaatgctaccgatttatgagttaatctcaataaataaatgactttgattcaagaataaatattaatacaagcttaatatcgctagaaagagtagctaccaagcatggatagattgatactcttacttattcttaatttactacaaaactttttgaatcattaacgtattcactaaggtagcattctattataaataaagcggctaatttaatggtcaacctgttacaataatccagatatcgagtgtatggaatgcaatgttcagctccagtccctccacttttatacattattttttcaccatcacgccatattgacgcatgatgagaaccatttcgaatagaagattcaatatcattttctgcaaagaccgaaaatataggagttaatttaaatggatttgatttatttgctttatttatttctaggtattttgatagcttcattgacttaaattcatcaaactctctaccgtccatgatattattcaaacaagcaataatagtcatatttgaagttagcgcttcataggcatctccataatatagctttatctgctcaaacccattagatgacactattaaatcatcaacattatgtccgattctagaatacattactatttgaccgaagtgatctctatggcgaaaatattcagagaatgtatttaaatagcgatattgattttcttgttttaactcactctgccaatacctaataaaactagaaagcttgctttcaggaatatttttaatcgtattaattatcggttctacaatgttttctaacatagggtaaaaaagggaatcaaaaaattcatgaatgatatgaaattcactataaacactacctgatttataaactataatttctttatcgcgcataaaattagatgatgatgggttcatatccttgtttctatgtttagtgtattgcaaaacaaaatttgaagcttttttgttatcttggatattagttatcattcctttaatcaaagaccatttgtgtggtgcatttggtatatcaaattgattatcaaaactttgcattctacctggtatatacctcatatgtggaattattagaggccccgaaattaatgtaggaaaacaaaaaggattatgtaaatcatgtttattaaatgcacaatttgggtgaaaatttaagacttcgagttcaatattaggctctcccgaaaaaagagagcaattttctacggcttctacatcagctcttggaggcttagtccttatagcaaagactatattaatattgcaattagaacaatcaaaatagtgtttctgataagaatcaaacccaactccaacccttattctgtagcgatgtccgcataactcacattttaatcctgtacttataaccattagttctccttattttccatcaccttactaatttctataatcattcataatttacgtttattcacataaacgttatctttcaagttgtaaaattttatcttaatcttattcgttttagaattccgttaataatgtttaatcaatgatattgatgccatttttagccttttgaaaaaaaagccttttggcctttttaggtaagacctttccattaggaaaggttacctttgacccttaatcccgttagagattcctttaaccttttagctttttgggtggttcatcaaggacataataattgataaaagtactcaatgaataatctgcattaatgaagggagttaactggatgttaggtggggagaagaccgattattgatacataagtttgacaatgttttccaaaagaaggacaatacccagagaagatagtccctcacaccacacaattagagcggaaatgttatactatcttactgataattcatgttaattaatacgttttttagtatatgtttttgactgggtaaatatcccctcggtcgttaaatatagtagggatcctcagagtgctactcggccggcttataatgagtaagtagagaatttctaggcagcggctagaaagaacaatggggagctttactccccattgttctttctacttattagttattagccatcaattttatctagagtagcatatttgctttttccttttagggatttatctcatcttcaaatttttttagtaatttatttacgcgttcaatttcttttgccaatttatagacattcgtatccaaacatctgagaacaaatagcatctttatataaatagctcttagtttagacttgaaaataggctcgtgatgacaaattctatttcttaattcattcacctcatcattaattttgattagtttttgggttagcttgttataatcttctctagttagcttcctatttattgaaaacaaggaactattgaaattatataagcgagggtatagtggatgcccagacttacctacactaccagaataatagaaatgtttattcaatacttcggtccaaaaagcgaagtttaatctagatacgatcattggtgcactgatagttgaagctcccaattcattcaacttatctctaaagaaggagcttaagcgcttcttgaagtagtaatcattaattgaatcgctaaattcactattcactacagcaaagattttgtttcttaacgtaacttcatataagtttattacttcaaaaagtgctgatgaaatctgaatattccacaaatataattttagtgatttcaagctaatatcagcaggagatagattaggttcagaagaatgaatgtagttttgataaacagaaatccgctctctagaaaaagatgtgataaaattagtaatacttaaattcatggtttagatgttgattgactattgacaacggtatgattctatcatactattaaccacgctgataggttgcacagattaagcatttgtcttaatgtcttaatgtcttaattttcccatcctatatatttagtggacaaagaccaccattttcgtgggtctttgtcattttagattaagaaaagtagaaatcagtcgaaattttcagccctaaccatgattatcaaaggcattatagcgctttctccttattcactatccatttcatttaagctatcgtaatcaccatattcaccatctgactcatcacctgatagttgcgactctaatacttgccgatcttcgtctcctagaaatttccaatagttacagattaattcactttctccatatttttcccacactccagggtaaaaatattcggcttctacatgacagattcccccgatgtgcggttctctgatatttgcttcaaccattaagcttattaaaaagaatggtagtaattttaaaaagacatttaacatggctctgttttagtagttttttggagattctaagagaattactattttttggtagaagaatttatctctgattctaaatcaatttattgctgtatttttattttgagcgagtattctgtctaaaaactttgatagatgtttttagatagtctgaaaacgggtaaagtatgagtttttagactaggattaacaaatagtctaaaaagtataaagttttgaacaaaggagaaaaacgatggtagaaatattcagtttagtggcattgtggctttgcataatttctttgtggattagagtttatcttttagaaaagaagattattgagcttaaaagcaaaattgataaatcttaagttttgcacatacaaggagcaaaaaatggaaaaaatcacagttcgcctaaattattgtctagcagacaatgaaattcgattagcaaacatagataaattaaagctaatcatttatttatgtgaaatgaaattggaaaaaggtattgatttaccttttaaagaggtaacagtaataggtacagattacatatctgatgattacactctaacaaaatcgttggggcaggttgtaaatcgatcaagaaaaataggggtcgttttcactctatgggaaaaatgggaacaaaaagaatctgatttttctaagtgttgaattttgaacaaaggagtatttatgaaaggctatgaaattgaacttgaggacaaaggacaggatttcacaaagttaagaacggatgaacaaggtatagtgatagcagccgaaccatatcaaacagatgtatggaaaggggctttaattcctatttctcaacaaaaaataggtgatttatgtatgattcatcatttaccgcatattgaatatggttatctgaaatacaaagtgttagccattaaagagattaactattaagttttgataagtgaggatacaaatgttttatgtaataacgtttttaatcttatggtgcggttttggactctatttactagataccgaaaagaaccctaatagaatgaatctagatgatttaaaagataaattaagaaaactttgaattttgaacaaaggagtaaaaatgcagtttaaaagtgtttctttcaaggtttttgtgtctgccaacatgcttatgctggggttatttgctttttttcttgctcctgcaattttacttaaacagcttgaatttaatggagctgaaatagttgaacttttaagtatttatatgggaatgaccgctgttatctctgctgtttgttttcttacaaagaagatcggtatcgcaaagtattttttagtggaatttatattgctagcgataatttttgcatatttaggatataaatttaatgttttgaatttttaataaaggagttaattatggactatgattatcaaaaaggctttgaagaaggttatagaatgattatgggagcatccgcattgctacctttagcacctattcaaccattgacgccgcttggaagcactccatttagagagggtttaaaagctggtataaatttagctaaaagaaataaccaacagtcatttaataacatttttaaataattttaagagataagatggcattaataggatttgctcgagtatcaactcaacagcaggatctaagtgaacagattcaagtattaaaagaatacggctgtaagaaaattttttcagggaagcattccggtaaagctgagaaaaataaagcacaattggatgaactactggattatgtccgagagggtgatgttgttgcagtaactaagcttgaccgcctaggaaggagccttgctcagtgtttgaatacacttgaactatttaagaataaaaatattggttttgttgcaatacaacaaggaatagatacccgaacccaaaacaatcctatggggatggccttaattcaattgttaggtatttttgctgaattggaaagaagttttattgtcgagcgtactcaggaagggaagcgaacaaaacttgcttcaggtcataaaaatgcattaggcggccgcccacctaaagtgacagataaaatacgtaaaaagatttatgcggattttaaagctggtgattctatttcaacagtaatgaaacgatatgatttatctaaatcaacggtggcgagactaaaaggtatttataatagggaaaatttaatggctgaagagtagaaaaaaacagctatgtatttcttgatattataaacaaaaatggcagggctcaactttgccattttcgtttggtttgtaaattggaaaagtctctaacagagttttttacatc

SEQ ID NO: 566 - DNA, 13379 bp, H. influenzae
gccagctacgttgcctgcaggtcgactcttggaaatccccttgcttatgcagtggaaaaggcgtaacgaatttacgcgtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaataagcggattttaactaaacccaatacctaatttatgaatttaatataaaatacacgtttgaatataaccttaataggagaaataaaatgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaataatctaaattgaaagcagcataacaaaaattgctatgctgttttgttttaatcccttgcaaaattcattaaaccttaaattttttgatctataacaaataaagttcaaataattgacaaactacctattttgggttgttctcattcattcatcgtaaacacataatccttcatctacagaagcattcagaaatattttaaagacattatgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataattttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttatttctcccatcaataaaagaggaagatgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaataatggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaataccgcacttttttcagcctattataaatttgggtagtttataaaaaaatctgcactttaattcgctgatttattcagcctttaaggtgcagattaattatattttctaaagtgcggttaatttttagattatttttagcctaagattttatctaactcttggctaacttcttctactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatctttaccttccacttttggtggattataaacgatgtggtaagaacggccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgtgccataaaagccacaaaagctgcggtaccaagtccaacgccgatatattctgcggcaatcacaacacctagtttccataactcggcagatgtaataacatcaaaatgaccgaaagcagacaaccaaataaacccaccaattgttaccatttgtacaagcccaaatagccacaatgcacggttaatacccagttttagcattatcataccaccagcaagcccagataaaatgcttgaccaaagtgcgttactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcacgttgattttcggctcttttgctaaaaataatgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgcagctaaactaggatcagaatagcaagtagcaatatcgccagcgcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcataaaatctgctcaaccatatatttagatgtaccataaggattggttgtaccgccgacctcacaatcctctgtaattggaataatttttggatcgccgtaaaccgttgcagatgagctaaatacaaagttccaaacacccgcttttttcatttcttgaattaatacaagggtgccagcgacattgttcatgtaatattctgtcggcttttgaacactttcccctacggcttttaaccctgcaaagtgaataaccgagttaatctcattttctgcaaaaatttttgtaacaaagcacgatctaaaatatcgccttcataaaactttgcttctttgcctgtaatttgttttacacgctcaagggattttggcgatgaattgcaaagattatctaataccaccacctctttgccagcatttaataattctacaactgtgtgagaaccgatataaccggcgccacctgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagaacaaccgaaaaatcagattttggtaaattcttggtttggaatatataccaatttttttatatacaaacttcggcggaattaaaatatcttgtgtgtaatttttcttttcttctggaataaaagcaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattgcagtcgccactgcacacatataaacgcctgatgtaatcctcttattctcatataattcgtgatattgtaaatgagcattaaaagctcgtagttttttcaaatagcaatgaccaagatcaatttgtggcagtaatttttctaaatgctggattttctttaatgttgaatcccctaaattcagaaaagatgctaagataatatcagcatattcatatttatattcattatttttaattaattgcataaacgtatagtattgttcaaaaattacagaacaattaaaaaataccttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgacatattgtaccgttcattgaataaaatagaagttatccctaaaaaataataaacattatatagatttatagaactttttactaaacgttgattataccttcctaaaattattatctaatatcagttgtactatctccgttgtatcttagcaagaaaaatttaaaaatgcttttcttgttccattcggatagaaacctaatcgcttgttttttctaccaaacaagcgtagacttaccaacaatttttagtcggggtgccgaaaggctgagatgatacccgtgaacctgaaacagttagcactgacgtaggaaactaatatgccaaaaaatccattttcttttcattccatttcttatcctttcttttttattacgcattccctttaatcattgaggcgagcaatggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggccgcctgttatgatggactacgcatatccctcaagcggggtttgattggcgaatacctttacattttccccttgtgttcattgctttaagggccaattacctgccgttttgccgcttttgtctcggtttttgaaatgccggttggtcgccccttcgtttcccggccattcccggtttctc

SEQ ID NO: 567 - DNA, 14669 bp, H. influenzae
ggcagcttgctgcctgcagtcgatctaaagaaccccttgctctaaccttctcggaaaggatgtgccatgtggagagtgcgaaaaaaaggctatcttcatagggttattactcgatctgcgtttaaacttgctgctataaattctccaagacctgcaattataaatccttctgcaagattgtagtgagctgtagttggtgtagttaagttatcaacaacacctcgtcgttgagatgctgcaacacataaatgtaaaggaacattgtgggtgatggaaaacatttgccaatgtttttgtaaattaacttcatcattggctggatacactaatgcatttccgttactcactccatcttggaagaaaaaaatctgtgagatttcgtgtccttttttgattaaggcatttgcaaattgataagctaaaaatgccccttgctttccgtaaatagggcttttgacggcgataacatagcgcattattcttgctcttgtttgatttgacggatgtacaggtaaaccgtatgtcgggaaatatctaaacgttcagcgactaaattaatcgcatctttaatatcaaaaatacctttttcgtaaagagaaaggacgatttgtcggtttttagtattattggcaacagcgcgatccgcattgacttcttctattgttttttcaatagtctgcgcaaccaagtcttccactgaattcgcaaagttcactgaagatgtttcattcgtatgctccgttggcataaagcattgcaaaaattgagacatgggtacatctaaattgatattgatgcaaagcaaaccaataatacgttgagttttattacgaatagcgatagtaactgatttcatcagtacgctgccttttgctcgtgtaaaataaggttttgaaacactttcgctttgcatatttcgtagcgaacgtaaggcaagatcagtaattggcgaaccaacttgtcgattagtgttatgtccgttggcaatacaaatagcagaatgttcaatattttccagagaatgaagcactatttcgcagtgctcgccaatcagtgcgctgacaccatcaacgactgctttgtaggaatttatgatagcttgatcttcatcagtgaaaggatatttatcgtttaatgtcatagcgttaggttaaaagtgcggtaaaaattccgctcgttttttataataaaaagcacgcgttaaagaacgcgcgctattaaacttatccgttatttttcagatttcggattgacgtctaatacttccacatcaaaaattaatgttgaatttggtggaatagatgcgccagcaccttgttcgccatagcctaattcaggtgcaataactaattgaatttttccgccttttttcactaattgaagaccttcagtccagcctttaattacttgatcaagttggaattctacaggttgtccgcgctcgacagagctatcaaatacttttccatttggtaatttacccgtgtaatgtactttaaccgtatccgttgatttgattgtatcgcctttacctgcactttcaattttatacattaaaccagattgcgtcgtttttacatctttccctttagcaaattcagcacggaatttatcgccttcttcttttgcttgtttagcaatcgcttctgcttttgcttttgatgcagccactaattttgcttcaatagattctaaggttttttggattttttcatctttacgaacatccactttgccttctaaagcatcttttaagccatctaaaatacgcgcattatcatatttaataacttctttgtgggaatcaacaagatctttcatttgactgcccatgagcgtacctactgcataagatgccgctttttcatcgaatgtgttatcttctgcaaaaacttgaccagaaattaccgcacttaccattaatgctgcgatagataatttttgaatttttaacatataagttaatcctttataatgaatggaataatacgaggaatagattaaatggctttctatctattctcaacttttttttagaatttagagaaaatttatgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattattgatttttgcaataaattcgtacaaatgaaaagggcgcttaatgcgccctttaaattacattctcaaataataatcagctaaatacttgcctgcttatgcaaagtatttttccaaatcgtcgctaccgccaatgtgtttaccaccgataaacacttgtggaacagtagcacgacctgaaactgcacgtacgctcacgattgttgcatcgtgacctaatatgatttcttcaaagcttaagcctttatcgtgtaaaagttgttttgcttttgcacagaaaggacagccaggttaaaaaaagattgaaatagactcttgcacttggtgttgtggtgcaaggtatttcaacatagtgtcagcatcggatactttgaacggatcgcctggttcgtttggttcgataaacattttttcaactacgccgtgtatcacaagcatagaataacgccatgaacgtttaccgaagcctaatcttctttaccaactaacatacccatgccttcggtaaattcaccattaccatctggaatgaaagtgatgttttcagatttttcatcttctttccatgcgttcattacgaaagtatcatttacagatacaacaagaatatcgtctacaccgtattttttgaatactggcgctaattcgttgtaacgtggtaagtgtgatgatgagcaagttggagtgaatgcgcccggtaatgagaacacgatcactgttttgttatcaaataactctgaggtagttacatcaacccatttatcaccctgacgagtgcggaatgtcacttgagggactttttttccttccatactagacattgttttttctcctattggttgttaatttaaattttacgtgctgtattatagggaaaattatgatatagtcataatcaattaattctattcttttaattgaatttttctatagggaaaatctcatgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaataatggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgccgaaattaagcattttgttgatgagttagcagaatatatttcctacaaacatcaatattcgcaatatgttgcttatgttcaagcggaaggcatcgtaacaatcgtattcactgcaggggcgaatgctttagatatgagtaaagctgagcgtgagcaacttaaagctcgtgtgattttgcagttgagaatgcttgcaaaaggtgctgattttgcagcgaataaggaaagaggcaagtaagatagtttatatctagcctattagttttctctttgtgcttaggtatttgctatcttttattcttccaagttatttttcataccaaattttatttatataaagggtaataaatcctgatggcgtttctacccgcacttcgtcgtctaatgtttttccgattaaagctcgagcaactggggaatcaatggatatccaatttttcgcaggggcaaattcatcacaaccgacgatacggtattgcttaatttcaccttcttcattttctaattccacccacgcaccgaagaaaacttttccctcttgctttgggttgtaatcgacaatttgtagcacttccaatcttttagttaaaaaacgcacgcggcgatcaatttcacgtaaacgacgtttaccataaatatattcggcattttcgctacgatcgcctagcgcagctgcatctgaaacggcttgagtgacttttgggcgttcttctttccacaaaaacttgagttcttggtcaagcacaagccagccttgacgggtaatataatttgattttgccataataaaaataaaagaaagttttttgaattatatttgagccagcccactaaaaccagtattctatctttgtttttttataataaagaagtacgacaatgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaataacaagttatagggcgaaattattcgccctttttttatcgctttcctttcccgaaaagcatcgccaaaacgggcgattttttgctataatctcgcccaatttttatttacaaaagaatgagataaattatgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagatctcgtaaggtcttgaagtacaacgttataaaggacttggggaaatgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtgtaaattttcgtctatttatattcaattcatgactgaaagggcaccaaagtgccctttctttgtttatcttgttatttcatataaggattactattgggtttttgaacttaagtgagtaaactaaatgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgcataactgttattttaataaaatacgatcgtaatagaacagagaaaaacaatgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctttaagtttcttatctaacaaaaaagtgcggtgaaaattgatctgcaccccaaaagttggactaaccaaaccaacaattgaggggcagattttttatgggtaaacactacacaatcgaatttaaattacaggctctccaacctattttgaatggaaaaatgagtattagagaagcggctcgtttttacaatattccttccaacgccttagtcgggacatggttgaaacggtttgaaaaaagtggcataaatggactgattccccgtaaaccatcaggacgaccgccaatgaaacccaaatatgccagaatgccaccgccacccaaaactgaagaagaccgtttacgtttgagaattttacagcttgaagcggaggtagcctacctaaaggagttgagaaggctcagacttcaggaagaagccgagcaacagaaattatccaaaggttaagaacacgctatccgttaaaatggcttttaggctttgcacggttagcgcgtagtacgttttttgctaaacttcagattaaacgagataaggatgagccgctgaaaaaggccattaaacgcatcaaagccaatcatcctgattatggctaccgacgtgttcatgcctatttgccaggtgtgaatcatatcgtcgaatcttggctgaacatggcatcattcaaagtatgtcgagaaaagggaattgcttggacaatgcagcgatggaaagtttctttgggcgattaaaaacggaatgtttttatggttgggaatttaacagtagagaggagatagttgatgccgtcagggattatttgggttactataatcaccgacggattcaactaaaattaaaaggactgagtccgatacaatatcgaaaacaatcctttaaataacagtctaactttttgggggcagatcaaatctgttacttactattggtatttcagttaataaattatttggtgttgtccgtagttcctctggtaatgttgattgtttactcttatggaaacaagctaaattaaagtccattccaccaagagatttctcctgcttaaagtagttatttttttgataacgttcagaaataaaccaataacacttataaccaatcttatctaaataggatatcaactcattagagtgatgaatatgagcttctacaaaaattataggcttatgtctctctatgagattctttgcaccatttaaaacatttagctcaaatccttcagcatcaatttttaatagatctatatcttccaatcgattaacttctgggtgtttatctaaagaaataacatgtatcaattccttagattctacacctataaaattaccctcggtactaaaccctttatctaatgaaaaacttccataattccaagcagtatcataatttgatgagggaatctcaatcaactgttcattttcaccaacccccaaattataggcatgaacatttgttaattgattaagcgacaaattcgcacaaagtgtctgaaaaattactctttgaggttcaaaacaaaataatttccccccccccccacttattgtctttgcaataggaactgcgtgcattccaatattcgaaccaacttcaatgacattacttgaagaatttaggttttccaaaaaaaattggacttctacatctgaccattcgccataaagtgcagcatattggctaataaaatccccttcaataagattaaaggttccccactttaattgataaatagatgttttcataaataatattccttagatttaaattaccgatactataacaaaaacagaactctttgtacgataaaataaataaaggaattaatttttaatcatccgtacaaattactctatacaaattctccgtacgacttacgaatctcttatatgttatctttcaactgcactttttcatcgcattttgctgtatttcacggtaaaccatctcaagttttcagaaataataggtaatttatgcgtcttttcattggaattttagtgggtgtttaaaccattctctttggcagattttcgatggaaaatgcggcactttactttggtattgcgagtagtggaaccccttagtcaatggttgaaagcctttcggaaaaacggtataaatgggtgccatcccaaacctaaaggtcgcccaagtatgaaacccaaatacgctaaaatgtctccaccacccaaaacagaagaacgtttacgcctacgcatccttgagtgagaagcagaggttgcttttctaaaaaagttggacgaaataatcaagagggacgaagctaaacggcagaaacagtccaaagtttgagagtgcattatccttatagattaagtcgtcgcccaaatggcatgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaataacagtctaactttttggggtcagatcaatttttaccgcacttttgttatctacttaattgattttaaagaatgtttgaaaattcttctaacatttcttttggccatacgcttgattgcacttcaccgatatgtttttggggatctccaagagtcgacctgcaggctagcaaagtgtgagc

SEQ ID NO: 568 - DNA, 13196 bp, H. influenzae
  misc_feature (13168)..(13168): n = a, c, g, or t
atccccctacattgcgggcgaacttggcgcatcttttagtcaagtacgtgggtaatcactttcttttggggtagcaaatggcgatttctacttccataacgggttggttagcaaaaacgttttggcgatgtgcggttaatttttaagtctcaacttttttatttgttgtctcttcttggctctgtgggattgcagatagtcttgaggcgttaattatttttcgcgtcattcaaggtgctgtcgcaggtccagtgatccctctttcgcaaagtttattattaaataattatccaccagaaaaacgcggaatggcattggcattttggtcaatgactattgtggttgcgcctatttttggcccaattttaggcggatggattagcgataatatccattggggatggatcttttttatcaatgttccgatcggtttgttagttgtgctaatcagctggaagattttgggaagcagagaaagtgaaattgttcatcaacctattgataaagtcggtttagttttacttgtcttaggagtgggatgtttgcaattaatgcttgatcagggtcgtgagcaagattggtttaattctaatgaaatcattatattagccgttgttgctgtcgtttgtctgattgccttggttatttgggaattgacagatgacaatcctgtagtggatatttcacttttccattctcgtaattttagcgtagggtgtttatgtactagtttagcctttttgatttatctaggttctgtggtattaattccgctcttgctacaacaagtcttccattacaccgcgacgtgggcagggcttgcggcttccccagttggattattcccaattttgctttcaccgattattgggcgtttcggttataagatcgatatgcgaattttagtgacgataagctttattgtatatgcaataacattttattggcgagcggtaactttcgagccatcaatgacatttgttgatgtagctttaccacaattagtgcaaggtttagcggtgtcctgtttctttatgccacttactacaataacgctgtctggcttgcctgcgcataaaatggcttcagcctctagcttatttaactttttgagaactttagcgggttctgtaggaacatctttgaccacatttatgtggtataaccgtgaagctgttcaccacactcaattaacagaacacattaatccttataacccgatttcccaaagtttttaccatcaaatgaatcaatttggtttaagtgatacgcaaacttcagcttacctcgctcaacaaataacatcgcaaggatttattattggcgcaaatgaaatattttggttatcagctatgggattcttaggattgcttattgtgatttggtttgcaaaaccaccttttagtactcagcattaaaataaatatatattacataccaatcacaacacaatcggtaacagttttagctctactttgcgcctgtactgcaagctctcgagtatcaaaacttgctacacgaacacggttccattcgccgttagtttgtatttgagcatttaatcctgtcatctgtaaacgaccttgcaaattttcagcttgcgctcgatttttaaaagcaccgcattgtaaaccaaatttcttgctatcccgtacattattaaccgtttttatttgttctactttttttgcgctttcaattttctgtgagtcttgctttttaattgattccaattttacgatttctgactctgtatttttcatatcttccgtttttttggattgagttctcgttgcatcttctattctctgttgctcagccagttttctagcttcatcagccgctttttgatctctttctatttgaattaaaacttgacgttgttcttctgttaaacgcatattttgttctacactcgctggattattatctacaggtacagtacgcgtttctaaggctttaatataactccacacttcctctggacgattaggtaacacacttttaggttgagctttttcctgttgtgttatagcttgctgcacgcttaccttactgttctgatttttcaacaaataaagtccaacaacaaaaactagaacaataaataaagcaagaaaaatcaagacatttgtattctttttcttattttttttcttattatttgagctacgacgcgcagcaaaatctcgatgtgccacaataaattcctagatttgaagtgataattttaataattcaacaaaattcgctaagtttactgaaaaatagtctttaaataaagactaacataagtggattatttatataattaacagaataaaaaaataccgcacttatacaggttatgctcaaaaaagttggataaaacaactatttataagtacaaattacgtaagataacctaagtgcggtttgttttttctatgttttaattagtgggttgttttattttcatcaaaaaccggtaatggtttgtgttcagttgcgatatagctatataccacaggcaagacgaacaaggtgaaaatagtaccaatggataatcccgctacaatcactatcccaatactaaagcgagataccgctcccgcacctgttgcatagagtaatggaattaagccagctaccattgccgccgttgtcattagaattggacgcaaacgcacttttgccgcgtgagtgattgcctcaattcgagttttaccatagtttagctgttcttcttttgccacttcacacattaagataccgtgtttagtgattaatcccacgagagtaatcaacccaacttgagagtagatatttaatgttgttcctgcgatgctaaagaaggataaaatatttaagctcaccaatgcaccacttacggctaatggtacggaaatcataattaccattgggtcacgtatagattcaaactgaatggcaagcaccaagaaaataattacaacagcaagaatgaaagtcgtcgtaagtgcattaccctcttgtactaattgacgagcttcggatttgaaatcataagtgtatccttgtggcaaattatcatttgcctgttgttgaagccaagcaatggcatcaccacttgatatacccggcattggtacagcactgatttcagccgaatttaattggctgaaacgcggtaatgatgttggctgagtttctaatttcatactaataacactacttaatggcactgattgaccattagatgcagttaaataataattttggaaactttctggcgataagcgatcatctcgttttacctgcgaaatgactttataagcgcgtccatccacatccacacgcgtaactgtcgcaccagataagaaactccctaaagtattactgatttgttgcatcgtgatgccgtaagtaccagctttctctttatctactgaaattgtcatttgcgccgtgtcataggtcaaatctaaatttgtataaataaatttgccagaggctttcatcgcactgaggaatttctctgcggtgtttgccaaagatttataatcttgcgcagttttcaatacaatagagactggagcgccttgttcccctgtatcaatttcaggaatgttaaatgctgatactgacacttctggaattgattttgctttttcattaatttcattcattattgcggattgtttacgtgaacgttctttccaatctttcaatgtgatgatatttaacgagctattagaagttggcgcaccagcaatgctcataccaaaagagacttcgggtgtttccattacatttttcatatatggttgcattgcattttgaatgtaatccacatttacgctagatggcgcattaccaattgcaataaatgcgcctttatcttcatttggcgttaattcactagaaagtgaattaaacaaaaatgggagcgttgagaaaatcacgaccgcaaaagccagcattgatttacgattgagcataacgagatcaagcatgtattcgtaaacacgatttactttacataaggtatgttctacgcgttcttccatccatgttggtttagcattggatttgagtaacttactactcatcattggcgataacgttaatgccacaacaccagaaataaatactgcaccagcaagggttaaagcaaactctttaaacaatgtgccagtaatcccccccattaaagccattggtgagtaaactgcgatcaatgcgatagtcatagaaattacaggcacggcaatttcacgcgtaccaataatcgccgctcggaatggcgtttctcccgctttaatatgacgatcaatattctccagcaccacaatagcatcatctacaactaaacctatggcaagaattaaagcaagcaaggtcattaaattaatagaaaagttgaaactttgtagcagcattaatacgccaataagagaaattggaatagccaatattggaattaaaatagcacggaacgaaccgataaacattaaaattaccactaaaacgatcaaagtagcttcaccaatagtttttatgacctcgtgaatagagctattaatggcaatagtgcggtcataaagaatatcgctttccatactgtctggcagttgtgtttttatactttcatataaagggcgaattttttctgcgacagtcaaagggtttgctgtcgaggttggattgatggctaacacaacggactctgcaccatttgccgtagcacgcgaattatcattttctttatttaattcaacggttgcaatatcacgcaaacgcactaaatcatcgccatttgatgaaataattaagttgctgagttgttccactgatttcgttgtagtctctactttattacgataactcacataatagccattatcgttccccgcagccgtttgtacattatttgcagaaagggcagacatcactgttggcacagaaagattttgagctgccattttttgtggatctagccaaatacgtaatgcatactcagccgcaccaaatacttgtacttctgccacgccttcaatcgtaaagaattgaggtttgactacacgattgatgtaatcagttacctgactagaatctagttttttagatcggaaactgatatacataataccgctcccacctgaagaagaggatacactaggatcttcaataccatttggtaatgctgactttactgcattcactttggctaacacatctgctaacgcgcctgcaggatcggtatttaatttcatttttattgtaatagtcgaactactaggcgcactagtcgaagacatataatcaatattatcggcttgcgcgatagattcttccaattttgacgtaacaaatgcttggattaaattcgcatctgcccctggatatgcggtactcactgtaatgactgtagtagtcattttagggtattcacgcactgccaatttcgagattgcttgcaaccctaaaataatcattaacaaactaattgaaactgctaaaacaggacggcgaataaatatatcggtaaatttcattcggatttcctcatacattaaagtggtgttttatgtgcaggctctactgcacccacaatgtcttttttaatccattccacaagacttccattaccaataccttgctgaccgcctgtaataattttatctcccgctttaacttcatttccctgtaattgagcataaacaccttgacgatctttagtaaatacggtgatctgtttcgcacgatagagacgatccaatttttcattacctgacatttttcctttttcttcttcagataatggttcaagtaaataggcaatttcgccatacatattgtagctaatagctacttgtggaacgacaacttgatttgtttcagttggtagcgcaatgcgtaaacgagagaacatacctgaaagcaatttatgcccatcttcaggattaaatgtagcttgaacatcaactaaacctgttgatgaattaatggcaggttcaatagccgtaattcgagctgaaaatgtttcgcccaagcgagcatctgttgtcgctgtaacgcgctgaccgatatgtaatttatctaaatcattttgtgaaagagcaaaatccactttcattgagctagtatcttctacacgcacaatttctgttccaacattcacatattgtccaacattgattttcacaatacctgctttgccatcaaatggcgcaacaattttacggcgctcaattactgcttttaaagattcgatattggctagttgagcgtcataagccgcttttgcgttatccatttcttgacgtgatacagcattgctgtttaataaacccacataacgctggtaagtttgacgaagtgctgataattgtgcctgagcagcttgtagattagctcgttcaacagaactatcaagttccacaagcacctcaccttttttcacattttgtccattttgcacaagtacttgagaaatcgtacctgcattttgtgtactgagcaatgcgccttgatttggacgcacaagacctgttgtgttaataactggcgtccattcacgcggttgaacttcaagtgcggttactgggcttgaagattctggcatttctgcaatggctcggcttatcattacgccttttattatattaaaaccgatgacaccgacaaaaattaagacaaataccactaaaattattttcatcaagaaaatatgtgagcgttttggtctttgatgttgagtttgactcatgtttaaagctccgttataaaaataacaacaattatttctgaatcgcacgccaagagcgttcaatcacagattctaaaatttcaggcttaagatcgaaatcgataaattttgcatcagaggctaaatttatcgccgttttcaaacttaataaaaagagaatatcttcagataattccgctaataagccagcttttttggcttggtcacaaaataaatcccaacgacaatttttaacgtttttacaaatatccttgaaattaggcaaagattcatattgctttaaattggatagaatggtgggattttcttgtaagaaataccaaatatttttccacatttgtcgatactgttcgaaaaaaggcttagattcatcaaaatctttttcaagtgttgccataaacattgaaaacactctatgtgcaaattgttcaagcaactcatctttgtttttgaaataaaggtaaatcgttcctgctgctacatttgcctcttttgcgattttatgcatagaaagccgatctaaaccttcttttgccattaaacgatcggtagcaagaaaaatttgttcggctaaatcagttttagcttgtcgcataagatccttgagtaaaataaggagcaataattgctcaaaaatgaatggacgttcattttatttattttttattttttggcaagttaaaaaacaaaaagcgtaacaatacttatctgtaggtaatccgtaaacccataagatgaatgataaacaaaggaggatataaaaaataggaatataaaatgcagtcaaaattaaccgcacttttcatcatcaaatcaaggtgtagaatgaggctaccttattttgtgtgataagaacgatgtcttgtatgcccttgcggtggtactgcacgttttaaccgatacggtttcggcagttcaagcaaggcttctgtttcatattggctcactgggatagaatggccaatatattcttcaattcctggtaaattcatcgcatattcttcgcaagcaaaactaatcgaaacgccactttcccctgctcgtccagtacggccaattcggtgaacgtaatcttccctatcatcaggtaaatcataattgaaaacatgcgtcacatcagaaatatgcaagccacgagcagccacatctgttgctactaaaatatctaaatcaccgtcggtaaattgttttaataacgataaacgttttttctgggctacatcgccagtcagtaaaccaacacgatgtccatcagccgccaaataaccccaaatttcttcacaacgatgttttgtattcgcaaacacaatacagcgctcaggccattcatcttccattaaggttaagagaagtgccattttatcctgattagatggataaaaaagttcttctttaatacgatgacctgttttttgttccggttctatttcaatatattcaggatcattcatatcctcaaatgctaattcacgcactttataagaaagcgtcgctgaaaataacatcgttaaacgcgcttgcggagcggggcatttacgcaataaataacgaatatcacggataaacccaagatcaaacattcgatccgcttcatctagcacgacaacttggatttcatctaaaccaattacgccttgttttacataatcaatgactcgccccgtcgtaccaatcaaaatatctacgccacgctcaatcacttgtagttgtttatcataaccatcgccaccataggcaagtgcggtctttaatccactcgcttttgcaagaaattctgcgtcattactaatctgtaccgctaattctcgagtaggtgctaaaatcaaagttcttgggtgaggatattcaagattaggatcttggtgagttaaaagatggtgaaaagtagccgttaaaaaagccattgtcttgcctgtacccgtttgagcttgtcctgcaacatctcgtccatttaaactgataggcaaggataaagcctgaattggggtacaaaaatcaaagcctttttttgccaaagcacctcgcacaatcggatgtagaggaagagcggagaatcgttgttggcttaaataatcttgttgcataaaaatcacattttagaataataaaatcacgtttagcatagcatttttaggaaaaatcctcaaaaaaagcaccgcacttataaaaattaaccgatagggtttcctatcggttaatctctatttaatgctccatccgtcactcacatttggatccattgcaaaatcagcagtatcacttggaatcgctttttcttcagccgcccattcgccaagatcaattaactggcaacgtttgctacaaaaaggtcgaaaagtactttcatttatccaaggcaccgatttttggcaaatcggacaaggtacttcaatcatttcgtcaggcatttttattttccgcttgttgtaaataaaactggtgcaattctagcaccttttgctgcaagtgcggtaagttttgggccagttcagaatcattgttaatcacatcatctgcccattttaaacgctcttgttgagaaacttgagaattcataattcgttgaatttgctcaaaattattgttatctcgttgtgatgaacgagcaagttgagtttgtggactcacatccaccaccaaaatacgatcacaaagtgcggtcaatttattttctattaataaagggacgacaaataatgtgtaaggcgcagtttgttcagctaatttttgtttcattcgttcacgaatagcgggatgtagaaggttatttaaccacaatttatcttcatcatggttaaacactcgctctcgtaaagccgcgcgattaagctcgccttgttccgttaaaatttgagccccaaaatgttcaacaatttttgacaataagggggaatctttcgcgacgacttctctagcaaccacatccgcatccactagaggtacgccaagatcggtaaataaattagcaatcgttgttttaccactaccaatgccaccagttaagccaacaatataagtcatataatttcccataaaaaataagcggcgatattaatcgccgctaaacatataatcaacgaaagaaaataaatcatttcggataaactggaagacgtttacaaattgctaatactttttctttagtttcagcaatcacttgttcttcattttctttgcctaaagcatctaaaacatcacacatccagccagctaattcacgcacatcattttcattgaaaccacggcgagtcacagatggtgtacctacacggatgccagaagtgacgaatggtttttgcggatcgtttggtacagcatttttattcactgtaatatttgctttgcctaatgccgcatcagctgctttacctgttaatccttgtttaataaaacttactaagaacaagtggttttcagtgccatttgacacaacgtcataaccacgttgtttaaatacctcaaccattgctttcgcatttttgattacatttgcttggtattctttatattgaggctctaatgcttctttaaagcaaactgcttttgccgcaataatatgaactaatggaccaccttgatttgcagggaatacggatgattgtaattttttgtagatttcttcatcgccacaagatgaaagaattaaaccaccacgcggaccgcccaacgttttatgggttgttgttgtcacaacatgtgcatgagggagtggatttagatataaacccgctgcaattaatcccgctacatgcgccatatccacaaataaatacgcaccaacttcatctgcgatttcacgcattttcgcccaatccacaacttgtgaataagccgagaaaccagcaacgataagttttggtttacattctaatgctttttgacgaacatcttcataatcaattaagccatccgcagtaattccataaagtacggagttataaattttgccagagaaactgacttttgcaccgtgagttaaatgaccaccgtgagccaaatccatacctaaaatagtatcgcctgcattaatcaatgcaccatacaccgcagcattcgcttgtgatccagagtgcggttgaacattcacgtaatctgcaccaaataattctttcgcacggtcaattgctaactgttccacaatgtccgcatactcacaaccaccgtaataacgtttacctggatagccttccgcatatttattagtgaattgtgaaccttgcgcttccatcacacgtggactcgcatagttttcagatgcaatgagttcgatatgttcttcttgacgacgattttcatcttggatcgcttgccacaatactggatcgtaatcagcgatagtcatatttcttgtaaacattgtgttctcctgttatgtaatttatggcagatagtttaactgtttatggataaaaacttaattaaaatttcattcctaaattttcattacttaaatgaaattaattcatcatagcgtctaatttaatgaacatactcttgtttaccattagattctatttttaggtatccagcatcacctgtgagaatatttccattaacaacccccttatcgcaagtgctaactgaatagttatatcccattatattaataataaagctagataactgattatgaaatgaaatcttacatgattcaaaattgtccaacactagtttctgtatttcttcatttggactatatagaactaatggcacaatataattatcttcatcaaatgtcccttgcttataagtgtcgccttttacatattgaccatgatctgatgtataggcaattatccaatctttagaagatttattagataagtaatggtaaacctctgagataaagttatcagtatttagaatagtattatcataattatctgttgcgttattttttccaaacaccttctctttttcatctaataatgccccatagggaatatgactccctctatgatgtaaaacaacaaaatgataaccattatctaaattaatatttttaaaagcaggaagtaatttattatcaggcattgaatctcttaaagaatacccttcattatctggaaaacgaatatcatcaatccaagctcctcctaaaaaattgatcatatgcatatcatccctagcttgagctgaataaaaatatgtctgaaagccttgctctttcgctaaattaaataaattcgtatctcctttagctatctgttgtattccatttggataaggaattgcattaaaaaacattggtaaagaaattgctgttagctttcctcctgaataagttttaccaacaagagctcctgatttatattttaagctatctaaaaaaggagatgtttttctcccgtaaccaaaagcactaaaatgacttgaggtcgcactttcccccataattaaaattatattcttaattttcggagagcccgatttcataggcttagatttatgataaagaggaatattagataaagaaaatatctcataaggaacaattcgtcctataaaataacccaacgataaataattggattttaatcgagaataaacagtgttaggtgaaataaaacgctcatgggattttgttgtatacgctcgaacaaaaacatacatcatcacagcataaaaaataaagtcaaaaatccaagaaagtttatatacttttctttttatgaaacttaaacttaaaaacacagcaacttcaaataaaccaaataacaatggatatatgaatttatctatcattgttaagccagcatttgttatctcattaatttctttaaatgcaagtgagtaattaacaggtccaatccaagattggtatactgcataatgtacattattaacaacaatacttattgcaaataaagcgccaactaatattcttgtaattctatattttgaaaaaacaaacaaacagacaaacagacagacaaataactttcagtgtatctctcaatactagaaatattaaataattttctataaataacttctaatgaaagaagaattgcataatataatactacgatgacaaattgtcgcataagttgatataacctcataaagtaacaaaataataattctaatttattgtcagagcaatcgtaaacgttgccctaacaaaatcctaaatcctaggaaaatacaattctaccctgtacaatattttttatctaattaaattcaacaagatttctaactattttgcttgttctcgttccacagccctgtaaccaatgtctcgacgataaaaacgcccagaccattgaatttgctcagccaattttaacgctttttgttgtgcttcaaatacactttcgcctaacgcagtcacacaaagtacacgaccgccgtttgtgactagcttgccttcttgttctgcgacacccgctaagaaaacttctcgtttttgaccgcactttaggcggggtctcntagagtcgactgcaggcagcaagtatgc

SEQ ID NO: 569 - DNA, 14324 bp, H. influenzae
ggtatacgaaatcggactcggtaccccttgcccccaaaaccttttaattcgcccatttttaataggctttctttaatatcatcagcagtagtaaaggtattttgtccaacaagtgcaaatgcactaatcggcttatcatccattttttctaaaatgctttgccaattaaaataaacaccaagtaaaaaaaagacaccaagcaataccgcaaaagcccgaatatgaaaataatatttaggcttttgttctccaaaacgaatattctgtggcgtttttcttttcagaatgttcattacaggctcaactccaaaattttcacgacgagttgctcaaaagaaatacctactgtcgctgcagattttgggaataaactatggctcgtcattccaggattagtattaacctcaaccaaacggaaattaccttttgcatcacacattacatcaatacgactccaaccacgacatcccagtgcatcataagcacgttttactaatattgctaactcttgctcgcgttcaggcgttaaacctgctgggcagaaatattgcgtattatcagaaatatacttcgcttcataatcataaaattcgccctctggaacaatacgaattgcgggtaatacttgattgtcaagcacaggcacagttaattcatcgccagctaaccactcttcaattagaatggtattatcaaatttaagcgcatattccaccgcactttttaactcttctaccgcttttactttcgttaagccaacgctagagccttctaaagagggtttaaccattaatggtaagcctaattttgccacaacagcctgaggatctaattcagaaaaagtttctcgggtaaccactttcatatctgcaacaggtaaaccaaaagctttccacaacatttttgtacgcattttgtccatcgttaatgcagaagccatcacgccacaccccgtataaggcaaaccaatttgctctaataaaccttgcattgtgccatcttctccaccacgaccgtgcaaaatattaaatgctcgattaaagccatcctttttaagatttgcaacattatattctttaggatcaataggatgtgcattataaccttgctttaataatgcttctaataccgctttgcctgaattgaaagaaacttcacgttcagcagatgtgccgcctaataacaccgcgattttttcttgttttaagttcattttctatcctgttcttcttactgatgatacttttctaatactaagattttcaatcaatccatctggcattaattcttccaagattcagccaagccacgagaaattttacttacgctaccagcaccttgtgccaaaatcaaatcgccatcttgaataatttgatcgagaacatcgcctagttgcgaagtatctgataccaaaataggatcaactttaccaagattacgaatggaacggcaaagagatttactgtcagcgccaacaataggggcttctcccgctgcgtacacatcaagcataatcaaagcgtctactagcgaaagcacttgtacaaaatcatcaaacaaatcacgagtgcgcgaataacgatgcggttggaaaatcattacaatacgtttatctccccagccttctcgcgctgctttaatggttacgtctacttctgttggatgatgaccataatcatcaactaaacgcactttaccatttggacgaataaattcgcctagctgatcaaaacgacgaccagccccctgaaaatcagccagagcctctaaaattgcctcgttagcaataccctcttcttttgctacagcaagtgcagccgttgcatttaatgcattatgttttccaggaacattgagcaacacattaatacgttcattatttgggcaaatcactgtgtaatgaccttgaaaacctgtttgttcataatcttcaatgcgataatctgcctgctcactaaaaccatatgtaatcacttggcgaccaacttttggcacaagttccattaaaacaggatcatcagcgcacatcacggctaaaccatagaatggtaaattatgcaggaatttcacataagtggctttcattttttcaaaatcgccttcgtaagtatccatatggtctggctccatattagttacaacagataccattggctgtaaatgcaaaaacgacgcatcactttcatcggcttcggcaattaaataacgacttgcccctaaatgtgcattcttacccgccgatttcactaaaccaccatttacaaaagtcggatcaagtttagcttgggtgtaaatcattgaaatcattgctgttgttgtcgttttcccgtgtgttcctgcaacagcaataccgtgacgaaaacgcataatctccgccaacatttgtgcgcgttgaatcactggaatgcgtttttgtttcgatgcaactaattcagggttatcatcttttatcgcactagacacaacaacaacactggcacctttaatatgttcttctgcatgaccaatgtagatttttgccccagcttgagctaaacgttgagtgactacgccatcggcaatatctgaacctgaaatttgataaccttcatttaataaaatttctgcaatgccgctcattcccgcaccaccaatgccaatgaaatgaatttgctgtacacggcgcatttcagggataatttttctaatttcttcgtgggaatgtttcatttatttttccttttctcccaatgacaaaactcaactaaaagtgcggttaaaattcgcaacgtttttatttctaatattagcacttttggatataaaaaatacttatgactgaggctatttataaaacgccacaacccctagtttgaatattgtttaattacttcagctacacgttgtgccgcattaggcatcgacattgttttcgctttcaatgccatctgcaataaattttcacgagttaaattttttaaataattcactagcatttcaggcgttaaatctgcctgttctataattttcgccgcgtcaacatctgataaatatttcgcatttaaatattgttggcgatctttatgttggaatggtacaaaaattgctgcgactcccactgctgcaatttcacatacggttaatgcgccagaacggcaaataaccacatcagcccaagcataagcctctgccatattatcaataaattctgttattttaacttgttctaaattctcgccataaagttggctgacttcttctaccgcacctttacctacttgatgacgaagctctaatttatctgcaagctgggcgactactttaggtaaagtatgattaagcactctcgctccttgactaccaccaaccactaagacacgtaatttttcctcacgatccgaaaaacgaatatcaggatttggcatctcaaataaatcttctcgaactgggtttcctactacttcagcatgaggaaaagcagttggaaatgcctgtaatacacaggttgcaattttacctaataacttattcgttaaacccgctatcgcattttgttcatgtaaaatgattggtacaccacaaagttttgccgcaacgccagcggggccagaaacatagcctcccataccaagtacagcgtcaggcttttcttcttgaataattttttttgcctgcaacacggcacgaaaaatggcaaaaggcgcatttaacaaagcttttatacctttaccacgcaaaccagaaatttgaataaatcgaataggaataccatattttggtacaagttgagcctccattctatctttcgtacctaaccagcaaatatcccattcttgtttttgtaaagtttgagcaactgcaatggcaggaaaaacatgaccgccagtgccacccgccatcactaataattttttatttttcatcttttttatctctaatcatcacgcaagcgtgcttgacctatacgaaataaacgattttcgtgatcaattcgcaataaaataccaatagtggcggacataatgataatactcgaaccaccataactcacgagtggaaaggttaaacctttagttggtagcattccaagagccatacctaaattcacaaagccttgaaagaaaatccaaaaaccaatacctaatgcaaaaaaacctcgaaaacgttgttctaacattaaggattctcgtccaattttcattgcacgaaaaattaataaacctaataaaagaataacaatcaatataccgataaatccaaattcttcgccgataatcgccataatgaaatcggtatgtgcttcaggcagataatctaatttttgaattgaattacctaatccttcgccagtaatttctccccgcccaaatgctataagagagtttgttaattggaaaccagtgccataaggatctttaaagggttctaaaaatcctataaatcgctttaaccgataagaggcggtcaatactagccaaacgaataagattccacctaatgctatcaatcctacaaactgtaaaattttcgcccctacgataaaaagcatcccagacataataataaatagcacgactgtactacctaaatcaggttgcaataaaagaaaacaacccaatacaagcataacaataaacggtttaaaaatactaacatgtcgcgaccgcacttcatcataacgacgagtgaaataacttgctaaaaaacaagtcaaagccaattttgcaaattctgcaggttgaaagtttaagatccccaatgaaatccaacgttttgcgccattaaccgatgtaccgataaaagggacaagcaataataatatgacagaaaataaaaaaattttagcgtgccatttttcccattgcgaagaagaaatttgtaatgaaatataacaagtgagcaaagaaagtagcacataaatagcgtcgcgttttgcaaagtaaaaaggatcattaaataaacgagagctataaggaatagaagcagatgttactgccactaaaccaattaaaagcaaaataacaaataaccaaaatagtgcgcgatcatacaacaaaccttgaggtgtgatgcgtgtccattcatcgtaattttttttgatgttctgtaaaaattccatcttatttttattaatgactaaattaggctgaatattgcgctaaatgcgtaaattcttcgccgcgcttttcaaaagaagcaaactgatcgagacttgcacaagcaggcgacaataataccatatctccgctttgcaatgttgggcgtaaaaattctatcgcttgttccattgtttcaaacaaatagctttgtgatgaaaattttgcaagctgcacaccatctcgaccaaaacaataacaaataatgtgtggttgattaattaattcagctaattctgaaaaatcagccccttttccgtctccgcctagcaacaaatgcaatttaccctcaatataaagcccagctaatgcagcaactgtactccccacatttgttgctttagagtcattaatccaacgaataccattagcttgatgcactaattgaaaacgatgatctaaccctttgaaatgacgaagtgcggtacgaattgaatctaaattaataccgacagcttgtgccaatgctgttgctgccaaaatgttcatataattatggcgaccgactaatgttacttcttcacaaggcaaaattacttcatcttttaccattaagtattgcttgccattttcagtttttagccaataatccgcactattttccgcaaaagaaacggtttgtctcgcttgattttcaccttcaccaaaagtcagcttatcctcattattcaaaactccgacctcagcattatgataaatgcgtaattttgcttggcgataatcttctaaatccatatagcgatccatatgatcttcagtcacgttcaaaacagtcgcagccgcagcttttaagctataagttgtctcaagctgaaaactagaaagctctagtacataaagttcacaatcttcattcaacaatgacaaagcgggaatcccaatatttccgcccataccaactttcacgccagcagctttcgccatttcataaactaaagtagtaacagtactttttccatttgaacctgtaatccccacaattggctttgtcgctgcgcggcagaataattcaatatcgccgattacttccactcccgctttaagtgcggtttgaatttctggtgtttttaccgcaagccctgggctaataacaatcatatcgctttcaagtaaccattcctgatttaaactaccagtatgaagagggatattttgaggaagtttatcaataccagtaggcttttttcgggtatcaatcacacgaatattagcctgttgggataagagataatccacacaagaaagacctgttttgccaagcccaatgatcgtaatatttttgttttgataggcattcattttatttcttcttaattactataagttttaaattttgctgatgggaatatcaatttataacgtaaaagctcgctctttcaaaaactgaaagagcgaacctcacaacatttattaacgcaacttcaaggtgactaatcccatcaacactaacattaaggaaataatccaaaaccgaataatcactcttggctcaggccatcccttcaattcaaaatggtggtgaatcggtgccattctaaaaatgcgttgtttgcgtaacttataagaccctacttgcaaaataacagagagtgcttcaacaacaaatacaccacccattatcacaagcaaaaattcctgacgaacaagaattgctacgacacccagcgcaccacctaatgctagagaacccacgtcccccataaatacttgagctggataagtattaaaccataaaaatcctaaactcgcgccaacaatagctgtacagaacaccactacttcagaactgtatttaatatacggaatgtgcaaatattctgcgaaattcacgttacctgtagcccaagcaattaaagcaaacgcacctgcaacaagcgcagtaggcataatcgctaatccatctaaaccgtcggttaaattcactgcattaccggttccaacaatcacaaagtaagataacacaatatagaacaaacctaactgaggcataatgtctttaaagaatggaatcactaaacgggtggcatcagtgtcgtgaccaagccaataaagccaaaggattgccactaatgccaccacagacatccagaaatatttccaacgcgcaatcaatccatcagtatttttacgggtaattttacggaaatcatccacaaaaccaattgcgccgtatccaaataaaacaaataaacaaacccaaatataagaattagcaagatttgcccataataacgtacttacgccaatagagaataaaatcatcacaccgcccatagtgggtgtgcctttttttgcaaagtgactttcagggccatcatttcgcacttcttgaccaaattttaagatctgtaaacgtttgatcactttagggccaatccaaagtgagataaaaagtgcggttaataatgcaagaattgcgcggacggtaatataagaaatcgcattaaaggcggtttcgtaacgaacaagatattcagcaagccagactaacatttaattttatcctttaatgaatagatcacatcttccattttcattgagcgtgagccttttcccagcaccacaacttttttattttgttgtaattggttttcaataagtggaactaagaaatccaccatttcagttttatccgtaaaatgcttacccaaaacagcctcagaaataaccgcactttcattgccataagaacacaccaaatctaaatttaccaaattaacatattgtccaacttcacgatgaatagcgagagaattttcgcccaattctttcatatctgcgacacatagaataaggaaagcatcataactttttaggacatcaatagccgcacagagagaatctttatttgcgttataagtatcatctaataacaataaattaggcgttacttgaataggaaataaacgccctttcacttgtgaacgttgttctaatccagctttgacatcggcaagcgtagcaccaacattcatcgctagtgcggtagcagctaaagcattttttacattatgctctccaagataaggtaaactaatatcaatttcgccttgcggagaaactaacgtaaaggttgaaccttgttcgttaccttgaacatttttgacggaatagtccttgccgttgaaatattgaatggcgtgattactaatttctttttgccaaatatctaagtgattatgttcagcattgataatcgccacaccattttttgttaaacctcgataaatctcgccttttgcttgaacaactcccgctaaagaaccaaacccctctaaatgtgcgggcgcaatattattaatcaatgcggcattaggttgaactaattttgtggtgtaattgatttcattttgatgatttgcaccaagttcaatcacagcaaaacgatgtttttctgttaagcgaagcagagttaaaggcacacctatatcgttattgaagttaccattggtaaaaagtaccgcttctgaatctgctgcggtatgctgcaaaatacttgctgtcatttcttttactgtggtttttccagaagagccggtcatcgccacagtacgcggattaattttctcgcgtaaccattttgcaagctcgcccaaagcaatacgagtgtctttaaccacaagttgaggaactaaaatagacgagttttcttgctgaacaacaagcgcaagcgcaccctgtgacaccgcttgatcaagatattgatgagcatcaaatttttcgccttttaaagcaaaaaataagctatttgatacgctttttcgagtatccgtattaatttcttcaacttgcacattttcatcgccaattaatttagcttgaagaatctgtgcaagttgtacagtagagagtttaatcataattgagtgattattattttaagaaatcaagtgcaatttcttggtcggaaaaatgcacaacttccgaaccaataatttgataatgctcgtgaccctttccagcaattaaaatcacgtcattttctaccgcactttcaatcgcaaactggatcgcctgtgcgcgatcaggaataatccccactttttccatatttttaaagccagcgacaatatctgcttcaatttggctttgtggttctgttcgtggattatcttttgtcacaataatcttttcagcaaactgctctgcaacctgtgccattaacggacgtttgcctctatcacggtctccgccacaaccaaagatgcaccataattcgccttggcaatgttcacgcgcagcaatcaacgctttttccaacgcatctggtgtatgcgcataatctacaataacgattggtttatttggatattgaatcatttccattcttccacatactccttttaaagatttcgccgtagcgagtaaattttccaatgggtaaccaaacgataacaacgtggtcattactaataataaattacttacattaaaagcaccaattaatgggctatgcaaaacaccattaccccagctagattcaaaagtaatatctgcacctttaaaatgataatggatatttattgctttcatccattggtgtgaacctactttaaaatccgcattcatacttacggcaatagcatcaggtagttcagttagccattggtatccaatttcatcatcagcattaatcactttaatttgggtatctaattcagtgaacaagcgtttcttcgccgcagcataattttccatagattgatgataatctagatgatcacgggttaaattcgtgaaaattgccgctttaaaatgcaaggcttctacacgatgctgcgccaaaccgtgtgatgaaacttcaatagaggtaaaatctgcacctgcgtgtttgaaagttgaaagagatgactgaatttctactgctgaacctgtcgtatttttagcttctacaatttgccccaaaagtccattaccaatggttcccatcacagccgcacgatgccccaataattccgcccattgcgctaataattgagaaatagtggttttgccatttgttcctgtaacgccaacaagggttaaatttttagagggcgaatcataaaaaacatcagctaaggacgaaagatgacgtgcaagttgataatatttaactaccggcacattcctgataaacgccacagttaaatgctcgctagataattctgtctcagaaaccaccgcactcgcaccagaatgaagagcagaatcaataaattgatttccatccacctgatgaccttttatcgccacaaaaagatcgccagctttaaccttacggctatctaacaccatattatggagttctatatcattctttaattcaggcaaattaaaaagtgcggtgagttttttcataatttttccttaattcactttttgattcttgtgttcgccaatataaacaattcgttttgcacttttcgttgttgtgttttcagctgcttcagcatcttgcggaatagcatttgcacgtaacgcatagcccataatgttagagaatacaggggcagaaaccgcaccaccataatattctcctgcttttggatcattgatcaaaaccactaatgcataacgaggatcactaattggtgcaatacccgcagtaaatgccacatatttatttacataatgtccattttcaatcttacgtgccgtacctgtttttacgccgacacggtagccttccaccattgtgcgtttatttttaattgctactttctctaaaattcccacaatatctttagttattttttcagagaaaacccgtttcccaataactggcggatcaactttagtgatagaaagcgggcgataaacaccgaaactaccaagggttgcataggcacgagcaatttgtaaaggtgtcgcagtaataccataaccataagcgactgttgcacgctcaatatctgcccagcgtttacgatttgcattcaaaatcccaacttgttctccgatcaagcctaaatctgtcggtttacttaaacctgcattttgataagtttccattaatgcgctaggtggcatacgtaatgcaagacgacttacaccacggttactagagttcattaaaatctcgtctaaagtttgctgagcacgtggtgcaacgtccacaatttctttaccgcttaatttaaaggacgtagtatcaataatttcatctcgtttaacgacacctcgttgaagtgcggttaaaacaacgaaaggttttaccgtagaacctggctcaaaagtatcggtaattgcacggttacgcattaactctgatttcacgccgacacggttgtttggattataagagggcgcagtcgccatagctaacacttcccctgttcgaacatcaactaacaccgcagtaccagactccgcattattctcagacaccgcctttttaatctcacgatacaccatagattgcaatttttcatcaatacttaaggtaacatcttgtgcatcatattttttctcatcggagatatgtgcaacaatattcccacgtttatctttacgaacagtacgtgaaccgtctttaccaacaagcagggaattaaaacttttctcaatgccttcaataccatttccatcaatatccgtataacccaccacgtgtgcagcttcttctacacgaggataaaaacggcgatgctctgtttctaaaataatacccttaatttttaatctacgaatatagttagctttacttaattcaacttgacgtgctaaatacaaataaccagatttagaatttttctcaatttttttcactaaatcattttcagtcatacctaattcttcggctaaagctgcaattcgttctttatccgcaagcgaattttccttcaacatcgtttttggatctgccacaatcgcgctcatcggtacgcttacagataaaagctgaccattacgatctaaaatagaaccacgcaccgataatacttcatctttacgcaaagaacgcttatccgcttcatttgataacgtatcggcattaatagattgaacataagctgctcgtgcgactaaagcacacagaccaagtaaaataagaaccgtagaaagcatataacgtccacgcataaagcatttttcaaacaccttttgagacttgttttgctttacagtttcaggtgcggtcaattttctaattgttttttttgacttacctgatttacgcgaggaattaaatttcaccatcttttttacctattattctctaatttcaacttcttgctctgaagaaacaactttcatttttaatgtactaatcgcaatagattctactcgcgtgctatccccttccgtagcttcctgcacttgtaaattacggtattcattctcaagtgcttgacgctgtaaaattaacattccattttcagaaattaattggcgagttttatgggttatccaaatcgttcccattgcagaaactaaaatccctatcaacagcaacaccactaacttatttgaagaaaataaatcttcgactaaaatctgctgtaacggataacgaggcttattattttcagacatcgctaaattctctctgccacacgtaatatggcacttcttgaacgaggatttgcttgaatttctgcatcacttggctgaatggctttaccaataattcttaatttttgattacgctgaatttgatcttctcgcaatggtaaacctttgggaatatcctcgcccttactttgttttttcataaaatgtttcaccattctatcttctaaagaatggaaactaataattgataaacgaccttctggtgctaacatatctaacgcagaattaagcagactttctaattcatctaattccgaattaataaaaatacgaatagcttggaaactacgcgtcgcaggatgtttatgtttatctttaaaaggaactgcctgtgaaataagttccgccaattgactggtacgcgataaaaattctgtgctattttttaccgcacttttattgaaatcaacaatagcagtggcaatacgtttagcgaaacgctcttcgccaaaagttttcaacacccaagttaaatcctcaatggacacttgttttaaccattcttcagcagataaaccttgagttgtatccatacgcatatcaagcgggccatctttcataaaactaaaaccacgttctgcttcatcaagctgaggggaagacacaccaagatcaagcaaaataccgtcaattttgcccactaaatttaatttgtcacaaatttcaggaatatgcgaaaagctgttatgttcaatctgaaaacgcaagtcttggattttgtgtgcttctgcaatagcacgaggatcacgatctacagctatcaaacgaccattagaagaaagttgagaaaggataaaccgagaatgccccccacgcccaaaagtaccatcaatataaatgccattctccttcaatgccaagccattcacggcttcgtgaagtaaaactgtaatatgttcagatgaagaaaaggaattttcgctattcataaatttaagataaaagtactacattattttctataatgagaaatcatttaacgcatcagcagcaaaatctgtgctggagccaatttctatatcctctgcaatttgagtatgccattctacatcgctccaaatttcaaatttattaagttgccctaccaacattaaacctttttctaattttgcgtgttggcgtaatggcccactaagcaaaatacgaccctgagcatccatctcacattcagtggcatggccaagcattactcgctgcaaacggcgttgggtaggatcaaagttagaaagtgcgagaagtttttgttcgattttttcccattcatcaaggggataaagtaaaagacaggattggcgaatatctacagtacaaaccatttgcccttggttcttttcaagaatttcagcgcgatagcgagttgggatcgctacacgccccttagaatctaaattaaccgccgttgcaccacgaaacatattacaccttaaaaattgaacttatttttagaaaatctctaaaaatctccacaaaacaccacttttctccacttctggcaagtttataatttgttcgctcaacttgcaagtaattccacattaaagcaactgatttttatcaaaataaaaaagccgtttgaataaacaattcaaacggctttttcatcaaattttattgactaattatttatataag

SEQ ID NO: 570 - DNA, 14547 bp, H. influenzae
  misc_feature (14474)..(14474): n = a, c, g, or t
  misc_feature (14508)..(14508): n = a, c, g, or t
  misc_feature (14518)..(14518): n = a, c, g, or t
gaagaaaccggatgaaggcaaataaaaaaagtaggaaggagataacaaaggaacaaagaaaagaaaaaaaaaagaaaaaataagcatacagataagaacagaaacaaaaaaaacaaggaggataataaagaaaagagggatgttagacacaggaggaaaaagaagatggaagaaaaaaaaaaaagtaaatcggggcaatattaaaggcacaaaaataaaaaatgaagagcagtagaataagcctatgatgtaagttaaatagtcggcattaatctaaaaagagcaaaggagtatgaaaaagtgatcaaaaagctaaaaagttatgataaagtagtcaaggcctattatacaacgggcaattactcgattttattaaaggtaatgacacacacaattgcagaattacattccgttttggcgaccaagattcagttaattgatgaaattcaatccactgaaaccttgatttcaatgcaaaatccaattttgcgagatattaaaccttaagaacatagaaagtgcggtgaaatttttattcaaatttatcttggtgtttaaatttcaataaatctctccgctcttttttatttgggcgacgatcaggatggggcattgaaagggaattattttttcttgcccacgcgatttcttctctttttttcacgctactttcggtttcttgatagagtaattgtgcttctggcgcacctcggcgttgatcgcttaaggcgataatttttatttctttttcttcgtttccctggcgaagttttaacattgcgcccacttccacaattttacttactttcgcacgttgattgttgtaatgcactttaccactttcaatcatcgctttagcaatgctccgtgttttgtaaaatcgggcagcccacaaccatttatctaatctgacttctttttctgccattattttctccttattttgattcgacaaaatagtaccacaaagtatgctaatgaactgttattaaaaattttattctttaataggatttttattaaatgaaaaaaaataaaaacaggttaatttaaacatttttcaataaaacaaattttatgttaaaaaaacttgaaaaatagtcaaatttttgacaaggttgagtggttttctttttttaagctcaaggaacaatttatgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaacaggaaagcggcgttccaattaccaatgggcttttcacttgccttactcggtgctggttatttaattggcattgtcggcggtattgcgatgttaatcggtgttattttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatctgattaatccttaaatttattttagaataggttatcttctggataacctatttttcactatgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaataattttatgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaattgattggttcgattggtttttttctctagaatacggcattattttcgacattactcggaagccgaataaggaataattatgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgggcagccgataaattaatcgcaaaacaaggcaaggtttggcgtaaaccaagtggattgatgaagaaaaaagtgtaacgatgatgacctagggtaggtttaccctaggctagcaagagtactacccctttggggtagaattaccgtttcccaaaatggaactactatcacgtaattagccgtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctctaatggaaattttagctcatattttaacttgcacttgtcacccttgaacatttctacattctctatttagaaatgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaagtaggagttgcctgcagtgttggcaaaattgatcgcttgtaggggcaaattacatttgccctataaaaacaattacagcggaatgtatgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagattaaaagggcgaatgtaataccctcctacaatttatctacatcatagacaaacatgtaggggctaattatattagccctcatcataaacaaagatttagtaatccaacaggagaaaacaatgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatctttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtgtagttaaaaacatcaataagaattaccgcactttaaactgttgccataaatttggatagtttattaatttgctgaaatattgggctctacataatgtagagctcaattatttatactaagggtatactttattgatggcagcgatcgtaaagcggttgtaattgttgaatggtgtgtgtaataaataaaatgggatctatttgatttaactcggctttttcaatacttttcccaatgcaccaaaaatcctcatctgaacgtaagatcagatttttttcagaaatgaccttcacttggcgaaaatcatcatattcactttcatcctctcgccaaatctcaaaatcagcaaattgtttgaaatcaaattgatcaagccactgattatattgttgcacattaatttgtgagcgatctgcacgatagcaatgccaatctaaacacactcttagtcggcgacgatttaatagcacagaaaagattgcggcagaattttggttaaactcgtatttaaaataagcgaagaaatgcgcccgtacctgccaaccattggtccagctttcaatatgcggtttcgcaaaaggcgtaccgagttgtgctgaaacagattgaattatcgctttccaattatcccaatgtaatttgtaatccgctttaatcgctggaatatcttctgggcagaattttttcatttgggcgaattgatagaaaggaatattgaacagttcacaagattcagcagtgagcgagagcatagcgtttccttaaaaatcactgtaatttttgaccgcactttgtgtgaagatctgcttgtcttcccagcgtaacatagtcattcgattattccacacacaaccagtatctagggcataaacaccttttggggtaggctcatccactaaacttgcccaatgtccaaagacaatgggaatttgtttataaagtggattacctaaattaaaccaaggcgtgagctctgtaggtgcatattttaaaggggatttacaggcaaaatccaagcgatgatctaaatagcaaaaacgcattcgagtaaaagcattaataatgtaacgatgacgcgctaagccctgtaaatcaggcgaccagcgatcaggttgttcggaatacatattttcaatgagataatgaaaatccccattttgtaaaatctgttccacttcagccgcacaagatttcgcagtttccaaattccaatcaggcgaaatacctgcatgcaccatcaggaagtttaactttttattatgtacaagtaatggctgatggcgtaaccaatgaatcagttcatcaaaatcgggcgcattaaaaatagcatcaacacgatcacgcggttttacttttttaatacccagtgcagtcgcaattaagtgtaaatcatgattgcctagcacggtttgtgccgaatcgccaagtgattttacgaaacgaaggcattcaagtgatttatccccacgagccacaagatctcccacaagataaagtttatcttgcgttggattgaagttcacacgttctaataaaagctgtaattcatcataacagccttgtaaatcaccaacgaaataggttgccatttttgaccgttcttttataaataaattttgagaattttaacacagacttttattgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatgtagaaagccaaggtgtaacaaggattacaccttttattatttttactcttctgaatctaatatttcatcgttattaacatctgctggtggattatctgccagccagttcgctaagcgcgcataatctgcgatagccaaattttctgcacgtgcatttaaatcaataccaagtgcggtcagattttcaggtgaaaatagtgttgaaagtgcattacgcaatgttttgcggcgttgattgaacgcttgggagcaaacacggttcaaccaatataaatcttttacagggtgcggcaattctttatgcggaattaaacgcacaacggctgaatccactttcggtgctggtttgaatgcagaaggaggtacttcaagtacaggcatcacttggcagaaatattgcgccataatggttaagcgaccataagctttgctatttggccctgcgcataagcgtttaaccacttctttttgcagcatgaagtgcatatcttgaatcacatcatgatacttaaataagtggaacattaatggcgtagaaatgttataaggcaagttaccaaatacacgtaatttttgccctttttctgctaaattctctgttgtataaagctcatcaaaatcaaattgcatcgcatctgtttcaataacggtgagcttttgatgtaaaaatggatggtgacgtaaacgttccgcaaggtctcggtcaagctctaccacagtcagatgatcgacaagttcaccaacaggctctgttaatgcgccaagtcccggaccaatttccactaagaattgattgggttgtgggtaaatcgccgccacgataccttgaattacagaagtatcatgtaaaaagttttgaccaaagcgtttacgcgccgtatggcctaagtgtttttttgaattcataagtactatttaataagaaaagtgcggttattatagagcctgtatttcttttgtaaattttagtgtaactgtcatgggtaatatcatttagcgatgagttccagtatagctttaatatgatgactcaaacttggattataacgaatacaatccattggattgagaatacggtgtagctgttcagatgcttgttttactgatttttgaattgcctcatctaaagtacttatgttttctctagaaaatgtatagccaaattcgttttttaatacttctaggcatcccatgttttcagaaaaaataactggcgtaccagataatatagattctagtccaacaagcccaaatggttcatattgagatgccataatagtgaaatctgccgcttgatataattcaggcatatttttgcaaaaaccaagtgaagaaattttaggattttcttctacaggcgttcctgcgaccactaagcgaataggtaactgagttttttcaaaatattttttcaaaatatcgaaaccttttcgcgtatggccagtagaagggaataggtaaatgatttcatcttttttgaaacctaacttttctctgagctttactctttcttcttcattgatttgtgtgaatttatctgtattaatagggggataaatcacatcaattttgttttcagagacatgatataactcaacgagttcttttttcattaatgcagaatgagcgatgacatatttggactgatttaaggatttttgttcacccatgattttaaatcgatctgatatgctgggctttttctttgatgcttgtaaatatcctttatgatttccaccacaaatgaccacgtcagatagggtgtaagaggttgtcagagagatttctgatgtttctttatatttatttgaaaaataggaaagaaacgaggttctccattttttaggaacaaaagaaagattaatcttaattggatataattagattatattcaggtaatgcagtatcaaacttggcagagtaaattttaggtgtaatgttagcctgagataatccattaacaatatcaataagatatcgttccatacctccaccgtattgaaatttttgacaggttaatgaaatatttgggtgattattattacttagtaatgttttattcatttgtatctacctagtaatggggttatttatgttgattatagggggtgttttgattttgtaaatcatttttcagttatgtcgaattgagttttttatgaacaatattattttttctttcgcagaaagctaaaaacggctataatccgcccgtttttcttaacttttccgcctaaagtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgttaattgcagaatatgtgagatagaccgatatatatcggtcttcttttttgctcaaaaagaactcaaactggttgcggaacgtaaaaaaatcggtataatccgcaacccttagccacattgaatttttcgttncccttgcctttgcagattggtggctgtactacgncaaaggctgnatgggtaccgagtccgatattcgtataac

SEQ ID NO: 571 - DNA, 11009 bp, H. influenzae
tctagtagatcccctaaatttatatgacacataattaaaagttggagaaaaaattatgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataattagcttaaaaaaggcggtgggcaaattgcttagtcgccttttttgtaactaaaatctaaaaactctataaaaatttaccgcactcttaaggagaaaatacttatgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacaaccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataatttataaattaattctcatacaaaaagagcggtcaaaacttcttttattttgaccgctcttttattctgtatctgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgcgcagtattacccgtatcaactaaatcatctaccacgataaatccttcgccaccatttggcacttgggctgcatgaagaacttgtagttctccctggttgttatgatcgtgataacttgcgatacaaacggtttcaatatgacgaagacccaattcacgagccaatacagccgctggaaataaaccaccgcgactcaccgcaataatacctttccattgagaagctggaagtaaacgttctgataattttcgggcatgcatttgaaacatatcccaagttaccacatatttttcgctcataattgcaccttagtttaaattttgcataaagatgcactacccgcgtttttcacagacgtaaatcaaatgtatgatgcattattgaataaatcaggggcaacaggtgtatttactgatttcccagatacttgcgtggaattcttaaaaggaataaaataatttctattataaccgtaggtaagtttacttacggttattaatgccgtctatgatgaaattatcttttcaattgaaaagtgtttttcagaaagacttactatatccttaatgaataggaacataatatgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaaaaccaatttaaatataatttagtttggggctaagctcattttttactggcttagcctttttaatttttcaagttcactcaagtaatcatcattactacagcctgaagttttgctatgatgttgcaagcctttcaaaatagaaatctaattcaatgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataaaaatagggcaagtatttcgtttgccctaaatttttctcccataaatattgcgcactgagtaaattagcactatccgcaacgcgatgagcttgagcttggtcaatattgaattgctcacttaaccctcaagcggtgcacgctcgaatatctgcaacttggaagttttttctaggctataaatgacgccttcgcgcaatgcaccgtcagaatagcgcatttgttgaatatgaaaaacctcaaacactgcacttaaaatcgctaaaccgggtacaaaaacatccacacggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaagcctaaatcttcgattttattgaccgcactttggcgcacgcgttgaaagttttctggggaaatgatgccatcggtaaaaaaattgagtcgcaaaactcacgcatcccatatgtcggctttcagccataagcggcgtgaaatcatcgccgataatcatttctgtcgagccgccaccaatatctataacaagctttctgcctttttctggctgagtatggcatacgccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcggcaaataaggctaagcaattcacgccacgtgtgatagcctcttgattaagcaccgcattttcatctaagccttccgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagcgtcattcataacattcctaaaattcaaatttataaagtaaatcaaacacttggtttgtgctagaaacggattgaaaataaagctgtggcattaggcgataacgtaatgtaacttctgctaacccatcaaataaacctacgccatattttatttgtaagcgattggtaatattgccacttactgtaaccttagatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccactactttctaacgaacgacctgttaataaataagaaagtgcttgatcttgtggtttgcttggttcactgaaaatagtgacttctgggctatcggctatgccaatcactctcactccagcagtaattttgctgtcttccattgtttcaggattacgaatagcctcaatattcaacgtaggttgtgccgcttgcccagaaaaactaataagccctttacgaatgagtaaatcttgtccgaaagaagcatagcgacctttggttaaattgatttgcccgaataaacctaaattgcctttgtcttgtttcacagaaagtaaaccatcaagattggtttttaagccataggcatcaaggctgacgtctttaccaatattgatgcgtaaatcagagcgaatatccattcctgatttcgtttttgcggcaaattcacgtttaatcagttcttctttgctcttgtgcgggccgtttaaaatcacttcatcttcgctgactggctcagcagtatctggcagactgtcaattttaatacgcgcccaaggaatatccactgttccgcttaaattcaattccttaggattggcttttatcgtgatatctggactgaaacgtagcttcgccatagatggaatatccacgttgaaattatttgcttgtgcattcaattctgtcgtccaatgttcaatattcgcccagtttgcacgtccagttaagtttaagtgactatctactgtttcgattttcccttgcaatgttgaacggttaccattaaagcgtagggcaatatcgccatctgtaatattgactggcatagatttcaatttggtacgaatattacgaatattgaagtcaccatttaataatggtttctctaaattcccgccgaaactcaacttcgagactaccttaccattcactgattcaccgctagtaagtagctgatttgcgatcgacaagtttaatcgttctatcgcaagggttccgccaagttggcgagttttaacaaaatcatttaaacgaatatcgcctacaattctgccttgattatgcaaattgatgtctgtttttaaaaccaaattattattttgaatgtcggcattaagggttaattttggaatatctaatttaaacgtgcggtaatccaatttttgagagaaagctaaatgattgccatctacttttgtgctaaattggaatggtttatccgtaaaccaagccacattaccttgcgcttgcaagtttcctttgaggctatcttgttcgataagtttattcattaaatccaaattaacacgtttgaattggaaagggatattaccttgcttgcctgcattgaatgcttgtgggaaacataattctatatctgtgttttgccagcaatgtgcggcaatattggcttgtgtttgtttgttatcgtaagacaccgcaatagcttggttagattttacatcgccaattggggtttcaaattttgcttgggaaagtgtgcctttccactggttccaagtgcggtcaaaaaggccgttaattcggaaatttgcagcaacaggctcgccttgagattttagattaattgggatttttgtctcgcctgataatcaagacaagtaaaggggttaatattttcccctaagaaagtgttcggattatattcattttccccccagaggggggattggtattagacctttatacttctttactaccgaaacctttcaagtaaatggagatgtcattcagatcgatagggcttgattcaccacaatcgtcctcccttttaatctacttaccccggttctcggccctctcaccccaactaaccatctc

SEQ ID NO: 572 - DNA, 7612 bp, H. influenzae
gggcgccgggatgaaaagagtgggttttcgaggcgggaactttatggggggggcgtgctcacacgaagaagctaccgcggggaaaaataggtttacataatcacggatcgattgcaataggaaaaacgttcccgcaaggcgaaacgctgaaatttacaggcattccaaattttgcgccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacattaaaatgacaaagtgcggtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacggggtatgctgtgataattacgctgtaaataacaaataaaatcgcgccgatactatttacaatgcgtaaatacacaatagatttaaataaaaaagatacagcaacaaaaaaagtcgccatataacctaaaaactcaataaaattaaaatccattattttgttctctttgattaaaaataaaaacggtgggtatgataaaagatttttaacgtaaggaaaagataagaaaaagaagcaaccgtttgcaagggaaatttatataaaaataagttgaacgagagccatatagaaaagcgtaccaacagcaatagatagaaacatatttttcttccagaaatgtaagccaagcacgactatccctgcaagcaaatcaggaataccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccaatggtaatgatttgttctgttaatgtcattttaaagattccaattttgtttctaatttagttatgcgcatagttagaattaaccaaatgccaattaatgttggaattaaaaaatattcttttcctataataagtaaaaaagcaaatgcaatccctaaacctaagagagagctttcgtgggatttttcttttagccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccaacctttatctaagtgctgtgggatttttgccatataatttagggaaaaagattcatctacaagtgttgtgattaaataccaacgtttttttcctatatgtatgccatatttttctagcattgatatgccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagcagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccttgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagggctgattgggttagatatacgtgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaattaatttttatctatcttagataaatttatatttagaatttttatttgctaacctggcggtgccctactctcacatggggaaaccccacactaccatcggcattacagcgtttcacttctgagttcggtatggtctcaggtgggtccaccgcactatcgccgccaagataattctttgataactcgtcttctcttttatctctcgtctcttttatctctcgttactcagtctttactctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggtt

SEQ ID NO: 573 - DNA, 22958 bp, H. influenzae
  misc_feature (8952)..(8952): n = a, c, g, or t
  misc_feature (9015)..(9015): n = a, c, g, or t
  misc_feature (22946)..(22946): n = a, c, g, or t
atcttacgatgtctgcatgataacaggcttgttaaaaacatatgaaaaggtcaatgtattactcatgatgaatacaaacttttaaacaaagcatgtagcactaaacccgacaatgttccacaagcctacaaaatgagagattcatcttactatgttgaatactcaccagaaactgatggttttgtaccaatgagtagtgaaaactaaaatcgtcataaagagctcaaaaatgagctcttttttcattttatgtattacatataggttttatcattctaatcaactaaatgcatctagacatcatttagaattattctggcttacattaaatacctatatacatttatcaagtacagtgaacttaaaatgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattcataaattcctgtgttaagctcctaaaaagtatgtacgaaataggagataattatgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatcttagattctaagttaccttgaaacttgtaaagtataaaaaaataagccaccaaaaacatggtggcttttatttactatcttttatatcgtttaaaacacatcttcgcactgccttctgatattgataaacaggttgctatttctcgccattttagaccttgtgttcttaactatactattttctcatatttactttttaagtcattttgtgatttcacccatccgaattcttctgaccaacgattcaatgagcttacactaatactaaattgttctgctatttgctttaacgacatattaggtttattagctccaaattgattaaacaactctttcttgataatttgttgcttttcccatcgttttcgagaacgatttgactgaatttgttgaaacgatgattcagaaaatctttcccaaatccaacgagatgaacttctagcaattccttttaactccctgtatggtaatggtggattatgattctgatttaataactctaatgaagataataaatactgattaaattgttctaattgtttacctgaacatttaaacttcagaacctcacgataaccaatttttttgatctgattaaataaagaacaattccgaccttcaatatcttcattatcatttagataaaatacaggtttatttgataaatcaacaaaatcagctaaataatccagagtatatttaggtacattaaatacaaatgttctccaaaaatttgagtttggatttttagtgaatacaccaacatagtgttgatctgctcctaacttatcaatataagctcgttgtatctttttaaaataacttattggcttaaatcgagcattctttgtgttacaaataggtacctccaacgcatagatataatgacatcgaccgtttaatctattttgtaccactatattgggacttggaagtcctaacaattcccaatccattgcagaattttcccgatctagatctaacaccataaatttaataaacagatcattaaactgaatatacttatgagttaatgcaacatctttagggtataactgcaccccattatcaaaattatctgtctactttatccgttctgctaagctttgattaaaatcatctaatgtatatgctgattccatatttacctctttatatatgattgaatttatgtggtagacatatctatctaatatgccttaactgagattaatacaaaaaaagtattttttaacttaatatgattattttttagacacttaaaacatgaaaaagaatcgaatgcctaaatcttaagcaaaaaatatagatttgtaacaaaatatcatcccatatcagatattaataatttaaaagtaatataaaataatatctaattaaattagatctcaataacttgatgataaaaatattgtttaaggcatattacaaattgaatagataaaatttagagattttttggatacatcggatactttttgatgtattgtatatactagagataatgttacatataatcagtgaacaagtaataaacagctacaatgtacacacctaaaaatagtaaccaatttggtaaccaattatcaaaacatgaaagaagattgattatatttacaatggttagagatgatctatttaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttcccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctgatgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattattctccttacgcctattggcgttagcatcggcaattattatggcggctatgagtttagttgcgcataatttttggttgttgtttattgctatcggtttgtatgcttctgtgaattcagcaggaatgccgattggggattcgttggcatccacttggcaacgccaaatcggcttggattacggcaaactccgtttgattggttctgctgcttttattcttggtgtagtagtatttggtggcatgattggctgggttggcgagccataatatcgtgtggactttaatccgcacttttatctttctataccatcattcagcttttaaaaccgaccattcccccaaaagatgaaatacctgaaggtggcgttcaaaatgatgttggttttattgctttactgaaaaatccgatgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaataggacgtatcgctttccttttaaaaaagtaatatgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagaagtctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaagaatttcgacatttgttctatcgaaaagtaattttggattctaaaatgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgcggcgttctttgtagaaacccctgttgaatcaaataaggctctaaaacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagcgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagtccgcacttcttgcaacgatagatgttaaatcttctacagaatagaattccaaacgttgcacaataccaaaacgatcacgcaatggagaagtcaaagaacccgctctagtggtcgcaccaaccaaagtaaaagggggcaaatctaatttaatggaacgagcagcgggtccttcgccaatcataatatccaactgatagtcttccattgctggataaaggacttcttcaatagcaggggaaagtcgatggatttcatcaataaataacacatcatgcggttcaagattggttagcattgcggctaaatctcccgctttttctaatacaggccctgatgtcgtacgaatattcacgcccatttcatttgccacaatattagcaagcgttgtttttcccaaacctggagggccaaaaatcaataaatgatctaaggcatcttgacgtagtttggctgccttgatgaaaatatccatctgctcgcgtacttgcggctgcccaacataatctgctaatagtttaggacgaatagcacggtcgataacatcttcatcaaccttagcttgcccgctaataattctatctgcttcaatcatatttttcctacaatgcggcttttaatgcttcacgaataacttgttcactggttaattcaggtttagcaacgcgttttaccattttttctgcttctgcaggtttataacctaaagcaatcaaggctgaaattgcttcatcagatgaactttccgagtgggattcaatagatggggataatggaatatgcgtactttctacaaagaaatcactttgttttatgcctttaaatttacctttgagttcaactaacaaacgttcagctgtttttttgccaacacctggaattttagtgagtttagaaagttcttctctctctattgcgtaagcaaattgttcgaccgacatggcggataaaatcgctaaggctaatttaggcccaaccccatttgttttaattaattcacgaaataaagtgcggtctgttttctgggcaaatccaaagagtaagtgagcatcttcccgaacaacaagatgggtgaataaagtagtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgagcgtgtgtaatcgcaatagccaacgcatccgcggcatcggcttgaggtttatctgataacttcaaaatacgagtcaccatttcttgcacttgtactttatcagcagaaccaatgcccacaaccgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgtctccctgtttggcgaatcacaccgtaacccgttacgcgagagccggggtcaatacctaaaataatgctcataatttctataaaaaataggtaattaaattacccatttattgcattattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccacctacgccacgatcaatagcacggttgatagtatcgcgcgtcatattgttgctaagtgctttatctactgctgcacgtaaacgcgggttagcactcacatcgccaccaccaattttagctgcggtaacaagttcacgaattaatttagtaaaaattttaccgcgttgtgcatcttgtgctgctttgcggtgtttaatattagccccacttactatgacctgccattntatttccctccatcaatctttaagaatatattttctaattgcttccgcattattggaagattntgtcatttggattgcttgttcaggggaaacccattgatatgccaaatgctcactcaatactggaataaattctttttccgcctcacacaaaaacaaatgttctttgcagtgagtaatattcggtgcgtatttatagcggaaatgtggaaaaatttcaaattctatgctctcattgcaatcaaaaagcgcggtggaattttccgaaatttctaaccgcacttcttcccatagctcacgaattgctgttttttttggtgtctcaccactttcaatggtgccagtaacagactgccaaaaatcaggatcatcttggcgttggagcattaaaactcggtttgtatttttagcgtaaattacaacaagaacagattgattatttttgtattgcatcattaaaaatgcggtcaaatctgaccgcacttcattcctaatattccaaacttattctgctttaacgacagaaattgccaactcttccaatgcttgcggatttacaaaactcggggcttccgtcattaagcacgctgctgccgtggttttcgggaaggcaattacatcacgaatgttttctgttccagttaaaagcatggttaaacggtctaaaccgaatgctaaaccagcatgcggtggagtaccgaattttaatgcatctaataagaaaccgaatttctcgcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacaacctaatttcaaacgtaacgcacccattgcatcagtggtcgtttgccatttgtctgcaccgaagaataaaatatcgccagtttgtgcattcacacgttctgctaacgctttccatacctcttcatttaagaatttcgcaatcggactttgcacgccttcaagaccagcattaatatcgtttacttttgcccaagccaaaccttttgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatccgaaccaaaacgacgcattgcttcttgccaagtcatcactgggaacttacctaaatctacaccaatggtatcaagccataagtcgtgcaccatacgttccataatttcgcggacttctggcgcagttaggaaagaagtttccacatcgatttgagtaaactcaggctgacggtctgctcgcaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggtaagcattggagtttcaatatcaaggaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacatcagaagcattgtagatgcgtaattctttcgctaacacttccacttcgcccgtagccatatttttattgatttggttttcaggacgcgcaatcacttcacctttaatttgaatacagaattcattacgtaacccagcagccgctgtcaatgcatcttgatatttaggatcaaaacaaacttgcacaatgccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatgttcaaaataaaggcttttttgtgccatatcatcagattttttgttatattatgcggcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctagaataacgactctttctctctgcctttaacacattatggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaataaaacaacggtaatttgatcttcttgcttgcatacagcaattgaaatgattagtatatacttattaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccacacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgccttttttctttttaagttattttctcaaggtaggatttatgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaataatggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttntcatttgttaaa

SEQ ID NO: 574 - DNA, 25523 bp, H. influenzae
  misc_feature (14470)..(14470): n = a, c, g, or t
  misc_feature (14490)..(14490): n = a, c, g, or t
  misc_feature (14501)..(14501): n = a, c, g, or t
  misc_feature (14528)..(14528): n = a, c, g, or t
ggaattcggctcggtaccccgaggtgcagcaacgatggactggatggaacaagaacaaaagcgtggtattaccattacctctgcggcaacaactgcattctggtctggtatgtcacaacaattcccacaacatcgtatcaatgttatcgatactccgggacacgtggactttactgttgaagtagaacgttctatgcgtgttcttgatggcgcagtaatggtttactgtgcggttggtggtgttcaaccacaatctgaaaccgtatggcgtcaagctaacaagtatgaagttccacgtattgcgttcgtaaataaaatggaccgtactggtgcgaacttcttacgtgttgttgaacaattaaaaacccgcttaggtgctaatgcggttccacttcaacttccaattggtgcagaagaaaacttcactggtgtagttgatttgatcaaaatgaaagcgatcaactggaatgaagcagaccaaggtatgactttcacttatgaagaagtgcctgcaaatatgcaagcagactgtgaagaatggcgtcaaaatcttgttgaagcggcagctgaagcgtcagaagaattaatggaaaaatacttaggtggcgaagacttaactgaagaagaaattaagtcagcattacgtcagcgcgtattagcaaatgaaattattttggtaacctgtggttctgcgttcaaaaacaaaggtgttcaagcaatgcttgacgcagttgttgaatacttaccagcaccaactgatatccctgcaattaaaggtatcaacccagatgaaactgaaggtgagcgtcatgcaagtgatgaagaaccattctcttcattagcatttaaaattgcaactgacccatttgtaggtaacttaacattcttccgtgtatattctggtgttattaattctggagatacagtattgaattctgtacgtcaaaaacgtgaacgttttggtcgtatcgtacagatgcacgctaataaacgtgaagaaattaaagaagttcgtgcaggtgatatcgcagcagctatcggcttaaaagatgtaactactggtgatacattatgtgcaattgaagcaccaatcatccttgagcgtatggaattcccagagccagtaatctctgttgcggtagaaccaaaaactaaagctgaccaagaaaaaatgggcttagcattaggtcgtttagcacaagaagacccttcattccgtgttcacactgatgaagaatctggcgaaaccattatttctggtatgggtgagttgcacttagatatcattgttgatcgtatgaaacgtgagttcaaagtggaagctaatattggtaaaccacaagtatcataccgtgaaactatccgtactcgtgttaatgatgtcgaaggtaaacatgctaaacaatctggtggtcgcggtcaatatggtcatgttgttatcgacttatacccattagatccagaaggccctggttatgaatttgtaaacgaaatcaaaggtggtgtaattcctggtgaatacattccagccgttgataaaggtattcaagaacaacttaaatctggtccattagctggttacccagtagttgatcttggtgtacgtttacacttcggttcataccatgatgtggattcatctgagttagcatttaaacttgctgcgtctttagcatttaaagcagcattctcaaaagcaaacccagtattacttgagccaattatgaaagttgaagttgaaactccacctgaatatgttggtgatgtaattggtgatttaagccgtcgtcgtgctatggttaacggtcaagaagcgaacgagtttgttgttaagatcgatgctgaagttccactttctgagatgttcggttatgcaacagatttacgttcacaaactcaaggtcgtgcatcatactcaatggaaccgttaaaatatgctgaagctccaacaagtgtggcagctgcagtaattgaagcgcgtaaaaaataatttttgtaaaccagcggtgtaaaatatgattgttttataccgcacttcttaggaaacattagcaatgtctaaagaaaaatttgaacgtacaaaaccgcacgtaaacgtgggtacaatcggccacgttgaccacggtaaaacaactttaacagcagcaatcacaaccgtattagcaaaacactacggtggtgcagcgcgtgcatttgaccaaattgataacgcgccagaagaaaaagcgcgtggtattaccatcaacacttcacacgttgaatacgatacaccgactcgccactacgcacacgtagactgtccgggacacgccgactatgttaaaaatatgattactggtgcggctcaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtagaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggggataacatcaagatgacagtaagcttaatccacccaatcgcgatggatcaaggcttacgtttcgcaatccgtgaaggtggccgtacagtaggtgcaggcgttgttgcgaaaatcatcaaataatagatgaactcttgaatgtcttaaagataaaagacagaagaagtaaaaagaaaagtgcggagaaaattctccgcatttttttattctatatttgataattcgtttaaatatttattaagttaatagattttagataataagtcatttatttgattcctagaacaataaatacattgctccttataaatgacacttctataatttttaattaattggcattaatcaaataaactactatgttatgtccactcaaatttcacttacgctattttttccataagaaattacgtcaaacatacagaatttcccacaaaagtttagaatttatctgcctaatcataggcatggcttgcctgacttggtttacgaaaaaatatactccatatgttggaggaagtggtattccacaagtgattgcatcaattaatcttcctcatagtagctataaaaccaaattagttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcattttggacgattattagcaaaggtatcgcaggattatcacctgaaaaaggcgtggctgggttcgccaacatcctatttatattgctttattattgggtttagtgcttgccgcactgttggagtggaaatgacaggcgcgcaactcgttctcatttggctcttgatttccagcattattgcatccataatctcgcgccaatttagtcctaaaccattttaccactttgctgcaggccggtttcgccagcaaatgcaagctcgtcaagccgaagaattacgcagcaaaaccaaacaagagaaataaaaatgcctcaaaatctaccgcacttttaccgcggccgtttttctgttgcgccaatgttagattggacaacacgccattgtcgttattttcatcgccaattttcaaagcacgcattactttacaccgaaatggtcactgcgcctgcgattatccatgccaaatacgatcacttggattttgatttacaagaaaatcccgttgcgttacagctgggaggaagtgatcctgaacaactcaaatattgtgcaaaacttgctgaggaacgaggttatcacgaaattaatcttaatgtaggatgcccttctgatcgcgtacaaaatggaatgtttggcgcctgcttaatggcgaaagcagatttggtggccgactgtgtagaacaaatgcaaagtgcggtcaaaattccagtcacagtgaaaacacgtattggtattgatgaattagacagctatgaatttttatgtgattttattgagaaggttcaaggaaaaggttgccaagagtttattatccatgcacgaaaagcttggctttcagggttaagtcccaaagaaaatcgagaaattccaccattagattatgctcgagtgtatcaactaaaacgtgattttccacatctaactatcgcaattaatggcggcataaaaaccattgaagaaatgaaacaacatttgcaatatgtggacggcgtgatggttgggcgagaggcctatcaaaatccaagtttacttgggcaaattgaccaagccttatttgatcctaacgctgcaattgttaccgctcatgaagcggtacagtcaatgcttccttatattgaacaacaacttaaccaaggaatacaccttaatcatatcgtccgccatatgctaggcgcattccaaaattgcaaaggtgcccgtcaatggcgacgctatttaagtgaaaatgcgtttaaacaaggtgcgggagttgaagtaattgaaaccgccttaagctttgtagaacactaatcacaaaataagccgcaaaagtgcggcttatttttcagctgtttttcttacgcaatacgcatttgaaaaatcaccaattcagcttggcaacagaaagtgaaatctgcctttaataaatagccatcatccagttttgtaatttcagattgaatttcacaaggttcactttctacatcacgcgctttctgagtaaaaaatgcgagtgcttcttgcgcttgttcttcactgtcataaatatattcaataacctgactacaatcacgattatcgaaaagtgatttcatatcaaatgtgttacaacctacacattcaatcggtttttcagtttgaattgccataatattatcccttttattcagattattttgcagcaacaaaacctacagcttcatacactttcgccaaggtttcttgtgcttttgcacgagctttttccgcaccttgtcgtaagatattatctaataaagtttcatcattgcgatattgatggaaacgttcttgtaaaccagcaagtaaagttgagacttcatccgctactgcagtttttaaatgtccgtacattttaccttcaaattctttttcaagatcagcaattggcttatccgtaaccgcagaaagaatatctaaaagattagatacccccgctttattttgcacatcataacgaacaacaggcggctcatctgaatccgttacggcacgtttaattttcttcgccacagattttggatcttctaaaagtgtcactacattgttgcggttatcatctgattttgacattttcttttcgggatcttgcaatgacataatacgcgcgcctgcttttccaatgaaaatttcaggaatagtgaaaatattgccataaagcgcattaaagcggtttgcaatatcacgcgtaatttctaagtgttgtttttggtcatcgccaacaggcacgctttttgcttgataaagtaaaatatccgccgccattaacacagggtaatcaaacaaacccacgttaatattttctgcataacgcgctgatttatctttaaattgagtcattcggctcatttcaccgaaataggtgtaacagtttaacacccagcttaattgcgtgtgttctggaacgtgagattgaacaaaaatagtacttttatttggatcaattccgcacgctaaataaagtgcaagcacatcaagcgttgctttacgaagggcaacaggatcttgacgaacagtgatcgcatgtaaatcaactacgcaaaaaatacattcataatcttcttgcattttcacccagttgcgcaacgcacccaaataatttccgatagttaattcaccagaaggctgcacgccactaaaaacaattggttttgccataatcaatccttaataccttaaaactgttcacacatcatatcagaaactctaggcttttttaatgttcgagttcaaaagctaggttaaaaatgctatatttaacggaaacgttttcctaatatttactaatgaaaaactaccacgatattgttcttgcccttgctggcgtgtgccaatcagcaaaattggttcatcaacttgcaacagaaagtcgagcagattcagatacatttttaaccgcacttaatagccttttcattacccaaccacaacgaattgaagatgtttttggtggcgaagttcgtcatttaaaattaggtctagaaaccttaattcaccagctcaacgcgcaaggcgatcaaaatttaactcgctattggctaagccttttagcattagaaggaaaattatcgaaaaactccgatgccaaacaaacattgggcaatcgaatttctcgcctaaaagaacaagaaattcattacgctcgcgatagtgaaacaatgttatctattatggcaaatatttacagcgatattattagcccattgggtaaaaaaattcacatcctaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaatacaattctggagtaaacatttatgcaactctctacactgaccgcactttcccctcttgatggtcgttatcaagataaagtaacgccattacgtgctatttttagcgaattcgggttaatgaaattccgtgtagttgtggaagttcgttggttacaaaaattagcttcaacggcagatattaccgaagtaccgccattttctacgcaagcaaatgcttttttagatggaattgtggctaattttaatgaggccgatgctgcgcgtattaaagaaattgaacgcacactaatcacgatgtgaaagccgttgagtattttctgaaagagaaaattcaaaacgaagtggaactagtgaacgtttctgaatttattcacttcgcttgcacctcagaagacattaacaatctctctcacgcattaatgttaagcaccgctcgtgacgaagtgattttaccagaatggcaaaaactgattgatgaaatcactcgtcttgcagaagaatataaaacgattccattactttctcgcacacatggccagccagcttcaccaagcaccgtgggcaaagaaatggcgaatgtcgtttatcgcctaaaacgtcaatttaaacaactccaaaatgcggagatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcgctgaattttttgatgctgtagttcgctttaataccattatcattgattttgatcgtgatttatggggatacattgcattaaatcactttaaacaacgaactatagcaggcgaaattggttcttctaccatgccacataaagtcaatccaattgattttgaaaactcagagggcaatctaggattagccaatgcagtgatgacccatttaggtcaaaaattaccaatttctcgctggcagcgtgacttaacagattcaaccgtattacgtaatttaggcgtaggattaggttattgtttgatcgcttatgcttcaacacgcaaaggcatgagtaaacttgaagtaaatcaaccgcacttattagaagaactcaatcaaaactgggaagttttggctgaaccaattcaaaccgtaatgcgtcgctacggaatagaaaaaccttacgaaaaattaaaagaattaacgcgaggtaaacgagtgacagaacaggctatgcgtgaatttattgataagttggatattccacaagaagaaaaattacgtttacaaaaattaacacccgctacttatattggggctgcagtggaattagtagagaagctatcataggaatttggctctttttccaacaatattctttacaagaacatagcttttctctataatcctgcgcctgtgttagtcaatctaacaaatttctggttggtgcttgacctattcaagccccatccaagaccgtaggggagtaatcttaattatcctacgtagatggtgaacagaataagaatttttcttgcttctgggcgccgaagtcatcctaatcttaggattaggtaaattaattccgagtaatcggagtgtattcaggagctaaaagccaatggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggcgttacaatgcgtgtagttcgtaatactttattacgtcgcgcagttgaaggcacagattacgaatgcttaaaagatacgtttgtaggtccaacacttatcgcgttctctaacgaacacccgggcgaagctgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaatcattaagcgtttcttacttcatctaactttatttattttaggaattgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggcgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataattctattttaaccactttaaaattcaaaaaaccgatgggaaaccatcggttttttcttatataaaagtttgttatagcttttacttaaaaacttaccatttgctatctttctaagatagaatattacccgtttttattgatgaataaagagaaaatttatgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaatagaataaaaaatcctacgtattatcgtaggatttttttataaaccaattttacaaatcgtaattaaaatcacataaaaaatgaccgcacttaatgttaataatttatttgctagtttaggtttatgttgatgaagacggtatagcattctagctgtaacagctagaataaagggataaacccaaaaaagcgttgaaaataaattgatttgccagcttgatagatagggatttttactaaatgctgtagaaattaataatgccattggacacaataatataggcgaacaaaaggcagcaagaccccaagcaaatggactaaatttagttggtaaagattgttttttcatattttaaataattaaaaataaatagatacaagaaagaaatataataaatatgttgaatagtaaagaatattttaatgaaagtaacaatgtagaaatggcgcacccgaaaggattcgaacctttgaccgctcggttcgtagccgagtactctatccagctgagctacgggtgcgtagatgatgctttaattattcataaccactttaataagatagagccgttttaaaaatggcgcacccgagaggattcgaacctctgaccgctcggttcgtagccgagtactctatccagctgagctacgggtgcagaataaataaaacaaacaatggcggtgagagagggattcgaaccctcgatggagcttttaaccccatactcccttagcaggggagcgccttcagcctgctcggccatctcaccacaatcagtgtgagcggtataatacgttttttagaaaatatgtcaaaccattttttgaaaaacacctttgtttgaatattttatctacacattaaatctatttttgagtgaaaagctactaattatttaaaaattctaatattttaaagattgtttcctttcttaatttgtcctgttcaaatagaatttcgtgtttagcattgaatacaacttcacatctagcattcggaaaaagtacggttaatttttcaagattgttgttatctactattttttctttttcggcttgtaaaattaggattggaatttcaatcttaggaataactttcggcaagcgtttaattgcgttcaaacacaaatgtacccaacggaatgttggcccgccaagattaattgctggatttttacgatttacacgattcatccatttcattctggttttacagaaagttaattcattgtattccaagtgggcttgttgataaggccctttaccaaaaacataacgctcgccttgtcctaaaatattcattagggcaataatcagttcatctctaatgggatgttttaaaagaataccgtaaaaaggcgaagaaagtaccgctttattaatgtgatgatcataatttgccaaataataggttgcaatcaatgcgcccatcgaatgagcaagcaaatgctgcgttgaatagctgaaaagtgcggttactttttcgatgattttcgccatatcatcaacatagaaacgaaattcgtctaaatgccctttttgaggaataatacgctgtgaatagccttgaccgcgatgatcaaatagcaatacatcataaccttgatgataaaaatcataagcgagctctgaccatttcaacatattttctgcacgaccatttactaaaatcatcaattttctgaccgcactttcaggttgaatcaaatgacgataagctaattttatatttcgtttaccagaaagatattgggtaggaaattgctcaaaaaaaggcaataattctgcaagagcaaattgatgaaaataaggttctctgatcataattttttaatgaaaagggcgtagtaaatacgccctttgtagtgaaagtaaacttacgccaccaattgttttaagatacggcgaactggctctgccgcaccccataataattggtcacccacggtaaaagctgccaaatattcaggccccatagccaatttacgtaaacgccccactggcacgcttaatgtacctgttactttcgctggcgttaattcacgtaatgtggtttctttgtcatttggaattacttttacccattcattatgtgatgcaataatttgttcgatttcttctaatggtaagtcttttttcaatttaatggtaaacgcttggctgtggcaacgtaatgcaccgatacgcacacataaaccatcaacaggaattggattgtcgcttaaacctaaaattttgttggtttctgcataacctttccattcttctttagtttgccctgtttcaggaagaagtttgtcaatccaagggattaagctaccgcccaatgccgcgccaaagttatctgttgggaagttatcagcacgcatttttgccgtcactttacgttcaatatctaaaatagatgaagcagggtcttttaattcacttgaaactgcttgttctaataaacccatttgtgaaagtaattcacgcatattttttgcgccagcacctgaagccgcttggtaagttgccacagaaatccattccaccaaatctttttcaaatagaccgccgatagccataagcattaagcttacagtacagttaccgcccacgaaagttttaatgccttttttcaaaccttcagaaatcacgtgttggtttactggatcaagcacaataattgcatcatctttcatacgcaacgcagaagcggcatcaacccaataaccatcccagcctgttgcttttaattttggatagacttcattggtgtaatcgccaccttggcaagtcacgataatgtctaattttttaagttcttcaatatcgaatgcacttttcaggtcgcctgcatccttgccaccaaaaacaggtgctttttgacctgcttgtgaagttgtaaaaaatacgggattaagatttgcaaaatcattttcctgcgacatacgatccattaatacggaacccaccatcccgcgccagccgataaagcctacatttttcattgttgtttccttagtttgttgtgcttgaatagcattattaattacaagatagcgttagcanaatcaagtatttttaatganaattgatcttntgtgaaagaaattaaataaaaaataanaaagtgtggttaatttaaaagaaaatttaatttaatcactcttttctaagttatctacttcaacacttattacgccatcttctgctttaagtaaagcatacgcatctttcaacattgtggaatcaatggaaaagcaacgaatttgtaaccgcacttctccactactttgatctttgacttgtatatgttcaatacgatactgattatttactaacaattgggtaactttccctatgctttccgcatcattgacaagaatattgaatttcgtccgacgacgttgtgatttacgatgaacccaacgttgaaccaacggacttaatcgaatagacaccaaaatcatcacagtggcgatgaccgcatcaaacacgaaacccgccccagcagcaataccgatccccgcagaagcccaaataatcgccgcagtggttaaacctgaaatcgcatcatttttcttatgcaaaatcacaccagcacctaaaaaaccgatgccactaatcacttgagccgcaagacgcattggatctgtacgaatattttctgaaacttgtgcataatgctctgcggcttgaattgaaacaatggttagcacacaagtggtaacggcaataatggcacaagtttttacacccacaggtttacgtttaagttcacgttctaagccaataacactgccaagcaccatcgctaatagcattttgctaaaaataattaagtgatcaggattgaaaagtgcggttaaaagtaaagatgaattttccatagtgataaaaataagtcagacatactcgtctattctacatcacttagcttaaaatctttacccttccaagcctttaatttatcgcctttcttgcgaaaattgagtaaaatcttgcgtttgaaattttatagagcgaaaacggttatttttatgcaaaattcaaccccaagcattggctttgtaagccttggttgcccaaaaaacttggcatttgggttcgcttacattatgtgtatccctatccccatgtggatgatttaattccattaatggctgacggtacgctattgccgtatttagacattccattacaacacgccagccctaaaatcttaaaagcaatgaaaagaccaggcagtattgaccgcactttagaacgcattaaacaatggcgtgaaatttgcccagatttaacattgcgctcaacctttattgttggtttccctggcgaaacggaagaagatttccaattattactcgatttcttaaaagaagcccaacttgatcgcgtaggctgtttcaaattcagccctgttgaaggtgcacccgcaacagatatggctgaccaagtaccagaagatgtaaaagaagaacgtttccatcgcttcatgcaattacaacaagaaatttctgcaaaccgtttaaaacaaaaaattggtaaaacccttgatgtattagtggatgaaattgacgaagatggtattattggtcgttcaaaagccgatgcccctgaagtagatgggttagtttacgtagataatttaagcggaatcaatgtcaaagtcggtgacgtgattaaagtaaccatcacaaattctgatgaatatgatttgtggggcagttgttaagtaacaacaatctcaacgaaataaacaaaaaatccatcttcgtattgaagatggatttttttattagccgaacactttttccaagtgtgcttggtagtctgctaagtattgttctacttgcggacttttaaccacatcgttacataagaatgtcggcaggcgagtcaagccgatgaactcgttgagtttgtggaaatgcatatacaaaacatccacgcctttgccttcaaagaaatcgccttcgcgagtaaaggcttcaatcggtgcattccaagtcagtgaaagcatgtgttttttgccttgcaacaagccgcctgtgccatagccctcggttggattaacgctgtgtctgccatcactgtgatataacttgccgtgcccactggttaatacttcgtctatgtattttttcactgtccaaggctcatgcatccaccagctcggcatttgccaaatcacggcatccatccacaagaatttttcgatttcagcttcaacgtcataaccagcatcaattacagtttctttgacattgtgtccaagtgcggtcaaaactctttcgttttttgtgaagcgaatggttcaactcgccgtgagaatgaccaaacgccttaccgccgtctaataataaaatattcatctttttgctcttaaataattataaaaaatggggttgccattatgcctttttacgttaatttttaaaagtctatttgtctgccacgttatttctagactataaggaagattacagcccgtagggaataaaccctagttaaacgcgtgggcttaagcccaccctacattggctacattagctggaattgaaagtgcggtaaaaaattggtggaaatcaaacgaaaaatgaccgcacttttaaaataaaaaatcggcagagaatttccctgccgatttttattaacttttcaaaatcgccctcaatctatcaagttggttttgtgttttttcttgtttttgctcggtggtgagttttggtttatcgcgttcccatagcacatcgtcattaggtaattcagctaaaaatcggctgggttctgggcgaactaattctccatattgacgacgctcacgacataaagaaaaagtaagttctttttgtgctcttgtgatacccacataagccaagcggcgttcttcttccacgttgtcttcatcaatgctggtttggtggggtaaaatgccctcctccataccaatcaaataaacataaggaaattccaatcctttagatgcgtgtaatgtcatcagttgaacttgatcgctgtcgtcatcgtcttcgcctcgctccaacatatcgcgtaatgtcaggcgggttaccacttgattaaggttcatcggctcattggtttcatcgccttttaacatatccgcaacccagtcaaataacgtggcgacattcttactttgcatttctgctgctttagggtttgttgcgtattcgtacaaatattcttcataatgaatcgcagataacatagaacgtaccgcacgttctggttcagaacgttgaatttcatcattaagttctacaatccaacggccaaatttttgcaatgaatcataggcttttggtgtaatgcgttgaataagttcaaactcaaaaatagcatcaaacaaactgatgtgtttttcttgagccaactctccaagtttttgtaaggttgcggtgccaatttcacgcttcggtgtattcacaatacgcaggaatgctccgtcatcatcttgatttaccaccaagcgcaaatacgccatcatatctttgatttctgcacgagagaaaaaagaagtaccgcccgaaattttgtaaggaatacggttttgcatcagtactttttcgagtaatcgggattgatgattgcctcgatacaaaatcgcataatctttatatttggttttacggctaaaacgatgggcgatcaactcggcgacaatccgctctgcttcgtgttcttcattttttgcttcgatgacaagcaatttttcccctgtaccaatggttgaaaaaagtttcttatcaaacacgtgctcattgttatcaatcaaaatattggcacaatgcaaaatacgctgggttgaacggtaattttgctctagcttaatcacgttcaaacgaggaaaatcatcgcgtaaacgcaccatattttctggtcgtgcgccacgccacgaataaatagattggtcatcatcgcccaccacagtgaaacaagcacgctcacccactaaaagtttaatcagttcatattgactggtgttggtgtcttgatattcatccaccaacaaataacgaatttttgcctgccattttgaccgcacttcttcattttgcttgaacaataatgtcggcagcataatcaaatcatcaaaatcgagagcgttgtaagctcgaatttgtgtggcgtaacgctcataacattttgcgaaagtttgatatttagcatcacgtgccaaggcaaatgcctgttttggcgaaatcaaatcgttcttccagttagaaatcactgaaattaactcgcgcaataaatccttatcttcttttaacacatcagcggttagctcttttaacaacgcaaattgatcgtgctcatcaaacaaggtcatatttgatttaaagcccaacgctttatattcacgcttaataatgtcaaaaccgagcgtatgaaaagtggaaacaagcaatcctttggattgttctttgccaatggaatgtgccacacgctctttcatctcgcgtgcggctttattcgtaaaagtgacggcggcaatttgtttcggagaatacccgcacttttcaattaaatgggcgattttattaatgattacgcgagttttgcctgaaccagcgccagcaagcacaaggcaagggcctgtcacatattcaacggcttgttgttgttgaggattgagtttcataagaattattgagcccacgcatagggcagtaatacagtgtctaataaaaatgagagaggcaaatctaagattggcaatccccattgttgcgccatttcaagatcataagcaacccctgcataggcggtatatttttctgttggatcgataagtttgaccacggaaccacaaccagataaaacgataagtgcggttaaaaaaataaaggtttttatcatcgtgcttttaacgcattgaatacaggctcaggaactagctcagcgacatctccgccatgtaaataaatttcacgcacaatggtagaagaaacaaacgcccatttttctgctggtgggaaaaacagactatctacgccttttgtgagtaaacgattaagggcggccaattgcagttcatattcaaaatctgttgttgtgcgtacgccgcgaataatggcagaaatattgtgctgtttaatcacatttgccaacaaatcagaaaagccaaacacctccacattggataaatgtgcaacagattgacgaacaagctccacgcgttcctccaacgaaaatagtggctttttacttgggctattcgccaccgccactaaaacacgaggaaaaattaccgcacttctttcaataatgtctaaatgaccgttcgtaatcggatcaaaagtaccaggataaatcacgctcgtcatacattgcgctccaaataaggttttaataaatctaacaaacgctgtaatgcccctcggttttccatcagcacttcatagccagcattgcctaaacgttcgcgggcttcttttgagtttaataaggcttctacggcgcgttctaaggaatctgcggttgaattaacttccaacacaccttgcacttccaccaacattctaaatatctcgggaaaattaaaagtatgcttgccagtaattacaggcattttaaacgcaagaggttccagtggattatgccccccgtgtttcacaaggcttccacccacaaaagcaatatcggaaatgccatacatcaacatcagttcgcccatactatcgcccaaaatcacttgggtattttcatttggtaattcatttgtggaacgacgaataaattgaaatttttcctttttaagtaaatcagccaccacattaaaacgctctggatggcgcggaacgagcaataacaataaattcgggtattttgctaacaaagcgcggtgagattttaaaatgatttcatcttctccattatgcgtgctggcagcaatccatattgggcgatcttgtttccaaagcgttcgcaatgaatcaattttacgtaatagttcatcattcgtattgagatcatatttaatattgcccgtgatattcaatttttcctttggatagcccaaagtggcatagcgttttccactaatgttatcctgcgctgcaatcaagctaatttgcgaccacattgtttgtaagtgcgcttttatttttccgtaacgatgtgcagaacgcgcagataaacgtgcattagcgataacaaatggaatattgcgtaaaaataattgatgaataagattaggccaaagttctgtttccatcacgatacataatttaggttgtacaaaattaataaaacgatggatcgaaaaaggtaaatcaagggggagataataatgaaaaacgctgtctccaaaagtggctttgacgcgctctgaacctgttggcgtaaaagtcgtaaaagtaatggataaatgcggataatcttgttgcaattgacgaaccagcggtatcgcagcaatcacttcccctacggaggctgcgtggataaagattccttgtggtggtggacaaggcacattgccataaaaaccataacgttcagccaaacgctgacgataacgtggagatttaacactgagcaagccaataaaacacaatatcaacggctggcaaattaaaagcaagctggtataaaaaaaacgccacataaatgaaattcggttatacttgaaaaaatttcggctagtatagcaaaaaaaggattgaaaatatgcctacaattagcgttgcgatgattgtaaaaaatgaagcacaagacctcgccaattgcttagacaccgtaaaagattgggtggatgagattatcattctagattctggtagcacagataacactaaagaaattgcgctcagttatggggctaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtagttcgtctctatcgcacaaactatgcgcaatataatgattcacttgtacatgaaaaagtggaatttccagctggcacaaaagtagaaaaattgacaggggatttagagcatttcacttataaaagtattcatcattatctagtgaaatccgcaggttatgccaaagcctgggcagaccaacgccaagctaaaggaaaaaaagccacactttggcaaggaatttcgcacgcgcttggttgttttgtgaagatgtatttgttaaaagcgggttttttagatggcaaacaaggatttttattagcggtgttatcagcgcattcaacctttgtaaaatacgccgatttatgggagcgagatcagcataaacactagcgagttttgcaaggacaatcatttaaatgatcgtccaccagccccatagattgcataaacgcatagcacgtggtttcgccaacaaagacgaaaccacgtttttttaaggcttgagaaagtgctttcgatacttctgttttagttggcacagatcgcaaatcaggcacatcattgacaatcggtttatgattcacaaatgaccaaataaaattactgaaattttcaccgcacttttccattgccaaataagctttcgcatttttgacaatggcttctaacttggctcgatggcgaattaatcctgaattttgcatgcaagcatcaatatcaagtgcggtcatttttgcgatttttttcggatcaaattgatgaaaggctgcacggtaagattcacgttttttcaaaaccgtaatccacgaaagtcccgcttgctgcccttccaaacaaattttttcaaatagcttttggctgtcgaattcaggctttccccattccttgtcatgataatcaatataaataggttgttcgccaacccaagggcatctggttatttgttgcatattaaaacttgacaaaataaaacattttgatatattccgagccaagtggatcgagggtgcttggtcggcgttatagcttcagtgagtttcattgaggcttttcgctttttagggctaagggaaatgtttcagtcctttttgatcaaaattttcccccagtatttttcttccaccttcacaataaaatttctttttaaggatctcaaaggctcgatttggttgattactatctaaaatatgtctcccgataggtcttgccactaaatccgcaacttgcaaccccacagaattaatttgttttggcacaatctttacttgaaaaggcaaggactttttaaatttattttgtccatcacaaatacgtaaaaattccagctctaactctctatcctcattacgtccacggctttccacggcaacaaaagtgattttatcttcttgatgcttttcacaaacaaattcgtatagggtttctaaacaatgtttgagtgaaaaatgataagggtgtgttgtttcattttgtggcgtttttcgcttatcaatcacacaggcagcaagaataaaattagtattttcaataatagatgaaatacgttccataaaaccttcacgctgttcacgagaagtgaaaatattaaaatcgcctttttctttgcggatttcatgctcatgcaatatcaccatatcatgaccaaaataatcaaattttatcttctgtatctgtggaacaatattatttcgataatggtctttataaaaaatacagaatgcaagtacaaacacaggatagtttttatcaattgactgtaaactgtgatctccactttcatcgacatacaccataaaatcgctgtatttattttccattgccaattaccttattttaattgctcataaaccgcgacaaaatctggcattacgcctcgccataaatggaaagaatgtgctgcttgcgcgactaacattccaaagccatcgctaacattggttaaacctaaacttttgcataatgcgataaatggcgtgtctgtgcctttcgcatattgcatatcgtaaaaagctaagcctaattttaaaatttcaacatcaactggagcagttccaccacttaatccagcggaagttgcattaatcactacatcataggtttgtagtggaatcgaatccatagagacagcttgaatattgccgtaaggctgaaatctttcagctaattctttggttttcgaaaaagtgcggttagcaagcacaatgttttgttgagcttgtaaaagtggcaataatacgccttttgttgctccgcctgcccccaagattaatacgtgttgatttggacgaagccaatttaaacgctccaaatccgtcactaaaccaatcccatcggtgttatccgcataaagttttccatcatcgagtttttttagcgtattacaggcttccgccaattttgctcgttggctatattcgtctgccagttgataggcacgttctttaaaaggcgaagtaatattgcaacctttcgcaccctcctcaaaaaatgccaaaagctgttgttcaaaagaatcaagattgcctaattttgcgatgtattccatagtttgatgggtttgcgcggctaactgacgttgaattaatggcgatttactttgcgtaatcggattgccccatacagcataaagatccataaattatccctgtctaaaaagttgatttgtgcgtaagtctcgaatttcagatggattgcgtgcatctcccacaatttcatccaatacaggaaaatctgcaccgaattgtaaccgcacttcatcggcggtacggcaaggtggctctcctgttaggtttgcgctagtcgaagttaatgcaaaacccgtgagttcacataaggctttcacagatgggtgatcgcacaaacgtattgcaatgctatcaaattttcctgtgagaaaatgcgaggtggtggatttagctggcacaatccaagtcgttggacgttcatatttaccttgcagatgagaaagctgttcatcgttaatctgctcaaaatcgacaaaaggacggaaaaaatccaagctaggagcgactaaaatcagccctttttccactggacgttgctttaaatcgagtaatttttttaccgcactttcactttgcggattacagcccaaaccaaacacagcttcagtgggataagcaaccacttgattttgtcgaagggcttcggcgatttgttctctattcatttcattcttttacttttattgctcaaaaatatgacggcaagttttatttgcacactggaaaatttgtttttccccattttcgctttttaacaaagaaagaggaaaatggcacgttgggcaaggcacggaataaggcttggcaggcaaagaaaatttacatttagggaaattatcacagccgtaaaaaatctttccttggcgaccacgacgagaaatcaaatgccccgttttacattcaggacaagtaattttttcctcagattcagattcttcccgcaccacaaaatcgcattcaggataatggctacaaccaataaacatcccaaaactgccttgtttcaactgcaataaattaccgcacttcgggcaaatttcatcaaatgtttttaatactttatgctccgatcgttgcaaaggacgcaaataatcacattcaggataagcagagcaacctaaaaacagcccttttttgccttgtttaatttgcaaaagcgcaccacattgagggcaatattcctgttgtttgctatgatgaaaaaggctttgattcataatctatccttacgcttgaagcatttcttccaattcttcctgtgcagtcatccattccgtttctacatcatctaatgctttcttcacatccacttgttgagccaaaagtgcggtcaatttttctttattttccgcattaataaattcagtatctgccagttgattttctatgttcgcaagctcagaagaaaatttattcattttttcttctaattgcgggattttttacgtatggggggcaagttgggtgggcgtactctgctcacggcgggttttggttcttacgattttgaccgaatttcattacga

SEQ ID NO: 575 - DNA, 28871 bp, H. influenzae
  misc_feature (82)..(82): n = a, c, g, or t
  misc_feature (5660)..(5660): n = a, c, g, or t
  misc_feature (28833)..(28833): n = a, c, g, or t
cctttggttttggtttaggtacaagctggcaatcccgcttaattcagcaagctattttaaaaaatcggattcgtggactcgngaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccataaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttgatttaactccctagcaaaagcacgcattttttaatgcgtgctttttgttaccaactttggcattccccaaaatctccgctaaaataaccgcactttttcttatcttctaggaaagcaatatgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaaaatggtcaattaatcgcgacaacacaacaagaagttttgatccgttttaatgaataagagagaaaaatgaccgcacttatacacaattttggcaacagtgttgaaaccgagtcaaaccttgaaatcttatattaagaaatgatgaaaaaataaaaagactaagttctattaacattctgaacttagtctttttaatgaaattaatttaacgtttaaatttattgcttacgccaagttgttccattcggcccatcttctaatacgatgcccatagcgataagctcattacgcgcagcatcagcagtagcccaatctttagcagcgcgggcctcattgcgttgtttaatcagtgcttcaatttttgccacttcatcatcgtcagaacctgcttgtaagaatttttctggatcttgttgaagtaatcctaaaatcgcccccaattcacgcaaacgcgcggcaagtccattggctttctcagcatcctctgtttttaacttgttaatttcacgcgccatttcgaataaaacagaaagtgcatttggcgtattaaaatcatcgtccattgcttcacggaaggtttccacaaaattttctccgccaaaaacaaccgcactttgatccgttccacgtaaagccgtgtataaacgttccaacgcaccttgcgctaaattcaagttttcttcgctgtaatttagctggctacgataatgtgccgttaataagaaataacgtacagcttctgcattgtaatggtttaatacatcacgaattgtgaagaaattgccgagagatttcgacattttttctttatccaccataatcatgccagaatggatccaataattcacatattggccaccatgcgcacagcaagattgtgcaatttcattttcgtggtgtgggaacattaaatcagagccaccaccgtgaatatcaaaatgttcgccaagctgtttgcagttcatagccgaacattcaatatgccagccaggacgacctgcaccccaaggggaagcccaacttggttcgttttctttcgacattttccaaagcacgaaatccattggatttttcttgatttcattgatttcaatacgtgcaccagcttgtaattgctcaagatcttgacgggataatttgccgtattctttgaagctttctacatcaaacatcacatcgccattatctgcaacataagcatgtccacgtttaatcaatttttccacaatttcaataatttcaggaatatgatgggttgcgcgaggctcaaaatcagggcgtaatacattaagtgcatcaaaatctttatacatttcctgcaccatacgatccactagctgatcgcaggtttctttgttttctaatgcacgtttgatgattttgtcatctacgtccgtaatattgcgcacataagttaaatcgtaacccaaagaacgtaaataacgggcaatcacatcaaaacacacaaaagtgcgtccatgaccgatatggcacaaatcataaacagtgacgccacaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacgacccttaattttttagagggaaaacaaaatggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgagtaacaaatgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataatcaggggattttttatagaatttagataaagatatttatgcacttcttcgacactcacacgcatcttgattatctccaacaatttactggggaaccgttgtcacaacttattgataatgctaagcaagccgatgtgcaaaaaaatactggttgtggcggtgaaagaagctgatttttaaaacaatccaaaatatgaccgcactttttcctgataatttgtgctatgggcttgggctccatcctcttttattcaagaacacgccgaaaagatttgattctgttagaacaagccttaaaaaaatcgtgatgcaaattgcacggcagtggcagaaattggtttagaacgcgcaattcctgatttgctcaccgaatgaactttgggcaaagcaatgtcatttttttgaaagccaactttatttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagacgcgtattgtggaaagtttangagccctttgcaccttaagaaatgaacctgctgaattgattaaaaaacttacatggaaaaatgcttgccagattttttcttgatccacgtcacattactgaaattattttgaattaaattgcagtcttcaatggcttaaaatccatggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaagatgaaagcgtattattgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccattaaggggcaatcttatcaacgctctaaagttacttatagctttaagcaacgattaaatatgttggttaatgaagttagccaattgagtttttggtaatgcaccaacttgagttgcaacaacttgaccatttttaatcaataataatgttgggatactacgaacaccaaattgtgctggcgttgcttggttgtcatccacattcattttcacaattttaactttacctgcaaattcaggtgcaagttcatctaacactggtgcaatcattttgcaaggaccacaccaaggtgcccaaaagtctaataaaacggggatatctgaattaactacaacactttcaaaatctgcgtcattaatgtgtaatacttcgctcattttgttttccttattttgtgaatggattccctatataagggctttttttaaacttacaagtgcggtgcagaataacaccgttttaaaaaatgtaaactaatcgttttaattgccaaaagctaagacggcaaaacaatattttcacacactttacccgatttcaatttataaacatttgataaagtcacatccgcaatattggttagtgcttcttcggttaaaaatgcttggtggcctgttagcaatacattatggcaagaagataaacggcggaaaatatcatcttgaatgacttcgttagacttatcttcaaagaacaaatctcgttcattctcatacacatccatacctaacgccccgattttacgctgttttaacgcatcaattgcagcctgagtatcaatcaaagagccacgactcgtattaacgatcatcacaccatctttcatttttgcaaaagcctcgcgatttaataaatgatagttttctggcgttgctgggcaatgaagcgtaatgacatgagatttagcataaagctcatctaattcaacatattgtccaccaagctcttccaccagtggatttttaaaaggatcgtacgccaaaatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacgacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgctctgccaaacgcacagtgctctcgttcagcataaaatcaaaaaattctaaatcgaaattatatttcgcattaatgagctcaatatattttctgtcataacttttagtgctatagattgcaattttcatggtttgctccaattattttaagtttgcaaaagcctgtaataagtccgctttaatatcttctacatcttcaataccgactgaaaaacgcaacaaggtattagtaatcccacgagctacacgctcgggttctggaatatccatatgagtttgagtggcaggataagtaataaaactttctgtgccgcctagactttctgcaaaagtaatcaatttgatggattttaagaatgtattaacccaagcttcatcttgcaaacggaaagacaacatcccacctttatttggataaagcaccgattccacttgtggttgagcttttaaaaattccgcaatggcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgccagcttgagctaataaagtatcaatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccactaacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatgtgcccgagtggtggaatcggtagacacaagggatttaaaatccctcgcctttcgaggcgtgccagttcaagtctggcttcgggcaccatctaattccaaaccaataatcagtacctagtccaatacttaactttaatttttaattatcgttaggtgaggaattatggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattcttttgcgaaagaatttatccgtggaactatcggaatgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggctaatatgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtgggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgcataatgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagcttaaaaaacataacgcccaacctagtgcgttacgttaagttgggcgttattcatatcgttagtaaggaacttgggaaagttcattggctattgtaaagatgtttaagcacattgcaacaataaaaatgaaatattctcagagagaattaaattatggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaatttatgcaagcaatgcgtggacttgatttaggaatctgtaaagcgattttatttgagctagaacagcgtgtggcaaaaggtgaagtgaaaaaacccacaaggtatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaattgaataagctgtataaaaagtgaatagtgtagaagggttctacaaagtacaaaatttaaccactgtaaagggactttacaaagtacaaattttaaccagtgtgcggggactgcacagtgaacaaaaattaaccactgtgctagggttgcacagtgaacaaaaattaaccactgtgctagggttgcacagtgaacaaaaattaaccactgtgctagggttgcacagtgaacaaaaattaaccactgtccaggggctggacaaagtacaaattttaaccaaatgataaaaggtgacataacatgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaataatggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacagggtatcaagtgcggtagataaaattaaagagatagaagagtcatttataacattcacatttgtgaacgttggatcttctagtttgtaatcggctaatttatatagtttgtgatcggctcactaaaaggccttttaaaggtaaggggacaagccccttaccttaacgaaaaaaagcctttgcctttcgtggttgtgttaaaaaatctctgtgttttttactgaatttacccttaaggattagatgtaaaaaatgcacaatcttgacagttaattttgtgatttaggagaaatcaatatggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattctgaactcaatataattaaggttaatcgtgatgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaataatacgacaacataaacatagtgtaggtaatcaatacctcattctcctttgccccaaccttagtggggctttttttatttcaggtgtttttaaatttcgataccgataataatgattattttgtatgatagataacgaaacaaatttgttttttgagatccatccaaacttttccttttcctcatattgtttaatatctcaaacgtttaccccttggctacaaggggtatttttctcctgtaattgcaaaaaataaattaagtggctcaaaatgaagtgaagataatgggcttgcatactttgacagaattttagctttctctttatggtttctaaccaaaataggaaactcctttacaccatttgcaagcaaccaaagcgttcttgtcataccatcattaagactacagcttatttctccatctttaatatgaacatttacatctgcaagtggaactggagaatccatacttttagcaaatccgttttcagcatgatgaaacttataatcttttctccatgttgactcatcgcccgcacatgtatttttatctacctcatacggtgatcgctgccataaagaaagaaacttttgagcatctacgatgacaatcatgttctcttgattagccatattttcaatatgctgtggataacgcatatacacgactttctgctctctcgttttcattctaaaaataatatatctatctcgacctgaatatctaagcgtatcaaccatcactccaattgatgaaggggtcagttttatcatgatttactcctcagtttaaaaagaattcctaattgtggtttatcttattacatcgaaaatatctctcaaatatcaatgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaactaggatttaagcgcctgtgaatggcgagccctcaaaaatagtgctatactaaagccttcgtaagaccgttcgtgaattgtcggttatcaattcacactagccaaaaatgattccagcacgctgaaaggaatttctcacattgattaacgctccttgtgaggtgtgccacctagttaatcagagtaatgatggagtaacgccccaatttactctcgacttttcaaatcgctggccattgcggatttttaaagtgtattgcaaagtgcattttgaaaattcgcaatggcttgctactttttccttaccggagcccaccggtgaaacaatgggtgccctttgtgtcaatttgatgccacagatataaccgattgatggccacaaagtaatcggataaggcgagccgtaaaaatccgtatatggtaacgaacgtatcagtatttttatgaatcaaattagtttggcctacttaatttttatttaatcaatctatagtcaaaactataaggtcattcaggaaactgggtgaccttttcttttgactaaaatatctccaaatagaatttttaattttttatacatttaaggtttgctttagattttaataacaacagtttttaaggtgctgtgaaaacagcctttaagaagttgcacgattcttgagaagcaacgccttgccttagcgcaagtagaatcatagccaaaattttttccagcacactgaaaggagaatctacgaataattcgtaggtgtgccaccttaaactacccttaacctaaaataagattacttattctagtttaatcacaatttaacccttggcgggaaacatttttcccgtgttgggtaaggatgtttctccgcttttttactacttaggagaaacattatgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgactaacctataaactgatgaaagccaacaacaaaatttgttggctttttctttaccctgaaggggaaactccccttatgggtggtttctccttttttatttctatttgaggagaaacctatgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcgtaaatttaacttttgaaaacataaattggagaaatatatgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgattaataacattaactttaatgtgcgataagcattcttttcgcaccttacccataggggatatatcccttatgggcgatattccctattttagaaggaatatcgaatgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatttagctaacaacctttcacccattgggggataacaccctcaatggcagtgttatcccctttactttttacattttaaaaatttaggagaaacacttatgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatattaatctatttaccttgaaagcctatctactttatgtagataggcttttcctttttaggatatgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaagggccttcgtcaatgtaatatctcaatctctcgaatgcctaagcttttcttttatcttttttacccggtgcacttaacaattattattggcattaaatatatttttctcagctaatttttctatctttacttcaagaagaataaattattcaaattcaggtgagagttatccatattaaggcattatttaaataccttaattggagcctcatcatgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaataagcaatgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctcccaacagaaaccgctatgcgttgggttgagccagcgtcaaatcaaacaaatcaacaagctattcgttggcaaaatccaaccaattaatacgagaacagaattatgcagtataaatcctttttcctctctttggtctgcttaggagcagtagttcaggcgcaagctgaattaaaagttattggtgattttggcggagaagtgcagtccgtttttatgaagcattacaaccggatgaatcaatggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaatgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattnccagtgatgcatgggtaccgagtcgatattcgataaca

SEQ ID NO: 576 - DNA, 929 bp, H. influenzae
ttttccccagggaaccagcttatgccatgattccgaattcggggctcggtaccctagactgaccctttttggacttcaggtggctggagtgagccctgctcccccctggctccttcccagcctgggcatccttgagttccaaggcctcattcagctctcggaacatctcgaagcgctcacgcccacgggatctgaagggtgaaatattctccatccagtggtttcttctttggctggggagaggagctggtgttgttgggcagtgctcgcttagtgctccctgggggcagctcgtggtgaggctcccctttcttgcggagattctcttcctctgtgcgccggtctctcccaggacaggcacaaacacgcacctcaaagctgttccgtcccagtagattaccactggagtcttccagtgtgatgatggtgaggatgggcctccggttcatgccgcccatgcaggaactgttacacatgtagttgtagtggatggtggtacagtcagagccaacctcaggcggctcatagggcaccaccacactatgtcgaaaagtgtttctgtcatccaaatactccacacgcaaatttccttccactcggataagatgctgaggaggggccagaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtacgtgcaagtcacagacttggctgtcccagaatgcaagaagcccagacggaaacggggattctttagagtcgacctgcaggcagcaagcttggcacttggcggcgtttacaaggcgggacg

SEQ ID NO: 577 - DNA, 374 bp, H. influenzae
  misc_feature (256)..(256): n = a, c, g, or t
  misc_feature (266)..(266): n = a, c, g, or t
  misc_feature (299)..(299): n = a, c, g, or t
  misc_feature (307)..(307): n = a, c, g, or t
  misc_feature (326)..(326): n = a, c, g, or t
  misc_feature (362)..(362): n = a, c, g, or t
ggatccattaccgaaaacttttgcacaaaaaaagtgctttcgccaatttgaatttcactgcgtgccatcagtcatttccccctacaaataatttaccgtccgcagtttcaagcgtccactcgcgagaacccacttcttttccaagctcaagtttcgccgatttaaccacccacgccgtgcttgcagcgaataatgagcgaccacgcaagtcttttaccgcaattggaaaggttgcgtttttactcactttatccgntgcatagagntcacttaacacatcattggtatcactggtttgnaataacgntaatgggacttttttacgnggatcctttaaagtcgacctgcaggcatgcaagctngcggaatcatgg

SEQ ID NO: 578 - DNA, 800 bp, H. influenzae
  misc_feature (358)..(358): n = a, c, g, or t
  misc_feature (376)..(376): n = a, c, g, or t
  misc_feature (435)..(435): n = a, c, g, or t
  misc_feature (443)..(443): n = a, c, g, or t
  misc_feature (445)..(445): n = a, c, g, or t
  misc_feature (466)..(466): n = a, c, g, or t
  misc_feature (468)..(468): n = a, c, g, or t
  misc_feature (476)..(477): n = a, c, g, or t
  misc_feature (481)..(481): n = a, c, g, or t
  misc_feature (499)..(499): n = a, c, g, or t
  misc_feature (502)..(502): n = a, c, g, or t
  misc_feature (504)..(504): n = a, c, g, or t
  misc_feature (518)..(518): n = a, c, g, or t
  misc_feature (521)..(521): n = a, c, g, or t
  misc_feature (529)..(529): n = a, c, g, or t
  misc_feature (537)..(537): n = a, c, g, or t
  misc_feature (549)..(549): n = a, c, g, or t
  misc_feature (566)..(566): n = a, c, g, or t
  misc_feature (570)..(570): n = a, c, g, or t
  misc_feature (583)..(583): n = a, c, g, or t
  misc_feature (586)..(588): n = a, c, g, or t
  misc_feature (592)..(592): n = a, c, g, or t
  misc_feature (599)..(599): n = a, c, g, or t
  misc_feature (605)..(605): n = a, c, g, or t
  misc_feature (614)..(614): n = a, c, g, or t
  misc_feature (617)..(618): n = a, c, g, or t
  misc_feature (621)..(621): n = a, c, g, or t
  misc_feature (623)..(623): n = a, c, g, or t
  misc_feature (629)..(630): n = a, c, g, or t
  misc_feature (635)..(635): n = a, c, g, or t
  misc_feature (637)..(637): n = a, c, g, or t
  misc_feature (640)..(640): n = a, c, g, or t
  misc_feature (642)..(642): n = a, c, g, or t
  misc_feature (646)..(646): n = a, c, g, or t
  misc_feature (655)..(658): n = a, c, g, or t
  misc_feature (666)..(666): n = a, c, g, or t
  misc_feature (673)..(673): n = a, c, g, or t
  misc_feature (677)..(678): n = a, c, g, or t
  misc_feature (680)..(680): n = a, c, g, or t
  misc_feature (687)..(689): n = a, c, g, or t
  misc_feature (691)..(691): n = a, c, g, or t
  misc_feature (696)..(696): n = a, c, g, or t
  misc_feature (700)..(701): n = a, c, g, or t
  misc_feature (709)..(709): n = a, c, g, or t
  misc_feature (716)..(716): n = a, c, g, or t
  misc_feature (722)..(722): n = a, c, g, or t
  misc_feature (746)..(747): n = a, c, g, or t
  misc_feature (750)..(750): n = a, c, g, or t
  misc_feature (752)..(752): n = a, c, g, or t
  misc_feature (757)..(758): n = a, c, g, or t
  misc_feature (771)..(771): n = a, c, g, or t
  misc_feature (774)..(774): n = a, c, g, or t
  misc_feature (780)..(780): n = a, c, g, or t
  misc_feature (785)..(787): n = a, c, g, or t
  misc_feature (795)..(795): n = a, c, g, or t
ggatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcancgccttgccttagtgcangtagaatcatagccaaaatgttatccagcattctgaaggatactctacgcaatcgtagnatgccacntnaagaccttccggggaaaatgntnccttcggnntgtntttttccaggaatttttnttncnattgggaaagactntgncccatccnctcattgnaccttgatgtcntcagtaccctttgaacncacntttatttgggggnaannntggncgttttngtgcgntaaacaacnccnntancnacaggnnttggntnatnancttnaacaaaacnnnngtttgaanacaaggnttanncnccgaaannngnatttntgtnncaaacggntaacacncttttnttttttttggggttggggggggcnnttncnggtannggagtttttcccnggnttcctnggagnnntgggaaanaaaaa

SEQ ID NO: 579 - DNA, 462 bp, H. influenzae
  misc_feature (368)..(368): n = a, c, g, or t
  misc_feature (389)..(389): n = a, c, g, or t
  misc_feature (399)..(399): n = a, c, g, or t
  misc_feature (401)..(401): n = a, c, g, or t
  misc_feature (406)..(406): n = a, c, g, or t
  misc_feature (420)..(420): n = a, c, g, or t
  misc_feature (423)..(423): n = a, c, g, or t
  misc_feature (425)..(425): n = a, c, g, or t
  misc_feature (431)..(431): n = a, c, g, or t
  misc_feature (446)..(446): n = a, c, g, or t
  misc_feature (460)..(460): n = a, c, g, or t
ggatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcctctagagtcgacctgcaggcatgcaagcttggcgtaatcatggtcatagctgtttcctgtgtgaaattgttatccgctcacaattncacacaacatacgagcccggnaggataaagngnaaagnccgggggggcctantgngngagctnactcacattaattgnggtgggctcactgncc

SEQ ID NO: 580 - protein, 29 aa, Artificial sequence
  Synthetic peptide
KVVGEIGFEPTTHWSQTSCATKLRYSPSD

SEQ ID NO: 581 - DNA, 68 bp, Artificial sequence
  Synthetic primer
aaccaaccaaccaaccaaccaaccaaccaaccaaccaaccaaccaaccaaccaaccaaccaaccaacc

SEQ ID NO: 582 - DNA, 52 bp, Artificial sequence
  Synthetic primer
ttgcttgcttgcttgcttgcttgcttgcttgcttgcttgcttgcttgcttgc

SEQ ID NO: 583 - DNA, 84 bp, Artificial sequence
  Synthetic primer
aagcaagcaagcaagcaagcaagcaagcaagcaagcaagcaagcaagcaagcaagcaagcaagcaagcaagcaagcaagcaagc

SEQ ID NO: 584 - DNA, 42 bp, Artificial sequence
  Synthetic primer
aacaaccaacaaccaacaaccaacaaccaacaaccaacaacc

SEQ ID NO: 585 - DNA, 32 bp, Artificial sequence
  Synthetic primer
gcaagcaagcaagcaagcaagcaagcaagcaa

SEQ ID NO: 586 - DNA, 147 bp, Artificial sequence
  Synthetic primer
tgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaaga

SEQ ID NO: 587 - DNA, 12 bp, Artificial sequence
  Synthetic primer
gggggggggggg

SEQ ID NO: 588 - DNA, 22 bp, Artificial sequence
  Synthetic primer
tgcccattaacatcaccatcta

SEQ ID NO: 589 - DNA, 600 bp, H. influenzae
  misc_feature (3)..(3): n = a, c, g, or t
  misc_feature (11)..(11): n = a, c, g, or t
ttnaacaaganattgggacaactccagtgaaaagttcttctcctttactcatatgtatatctccttcttaaatctagaggatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgt

SEQ ID NO: 590 - DNA, 600 bp, H. influenzae
  misc_feature (22)..(22): n = a, c, g, or t
taacaagaacttgggacaaagnccagtgaaaagttcttctcctttactcatatgtatatctccttcttaaatctagaggatcagcatcacatcgggcggaataggaaaaaatatcgcctcgataaaacttacaaaagagagccaaaaaacagcaaaacgatgttttgaccattccatcgttttatcgtacatcgtgccgaaaattttcatatttttctctatttggtaaattcctgctctaaccaattttgcaaagaaagcaatgaatgatatgcggtaagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggcctccatcggagaaactgtccgaggttatgttgacctgcaggg

SEQ ID NO: 591 - DNA, 600 bp, H. influenzae
  misc_feature (1)..(1): n = a, c, g, or t
  misc_feature (446)..(446): n = a, c, g, or t
  misc_feature (453)..(453): n = a, c, g, or t
  misc_feature (517)..(517): n = a, c, g, or t
  misc_feature (520)..(520): n = a, c, g, or t
  misc_feature (526)..(526): n = a, c, g, or t
  misc_feature (528)..(528): n = a, c, g, or t
  misc_feature (539)..(539): n = a, c, g, or t
  misc_feature (542)..(543): n = a, c, g, or t
  misc_feature (548)..(548): n = a, c, g, or t
  misc_feature (552)..(552): n = a, c, g, or t
  misc_feature (554)..(554): n = a, c, g, or t
  misc_feature (556)..(556): n = a, c, g, or t
  misc_feature (594)..(594): n = a, c, g, or t
nacagattgggacaactccagtgaaaagttcttctcctttactcatatgtatatctccttcttaaatctagaggatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggnaaccatncgcctctgctaaggttggtaaataagtattatgccctaatacacgattaatcgaaaatacttcngtnttcagngntaaaaacaccntgnnggggnaaancnanggggtttgggggaaattttacccccgggacgtaaattnaataaa

SEQ ID NO: 592 - DNA, 600 bp, H. infleunzae
  misc_feature (9)..(9): n = a, c, g, or t
  misc_feature (524)..(524): n = a, c, g, or t
  misc_feature (531)..(531): n = a, c, g, or t
  misc_feature (557)..(557): n = a, c, g, or t
  misc_feature (585)..(585): n = a, c, g, or t
  misc_feature (588)..(588): n = a, c, g, or t
ttaacaagnaattgggacaactccagtgaaaagttcttctcctttactcatatgtatatctccttcttaaatctagaggatcgtagaaccataaggttttaccatcagaaataatctgggtttcttgaggggttttagtctccatacggaataaatttgggcgtttaatttgaagtttgccacttccttgttgaacattttttccacttccagaagtcactgtttgcacaaattctgcacttaatacatcgactttagctaaacgcatttgtaattcacttgccgcatcagccaatgccaaattactcaaaccaagtaaggtaagtgcggcaaattttaaggttgtttttttcattttactttccttttaaattagtattctggacgatgcgataaaatttcacgcttaccattttgcattgggctgacaatcccttgctcttccatttgatcctctagagtcgacctgcaggcatgcaagcttggcgtaatcatggtcatagctgtttcctgtgtgaaattgntatccgntcacaattcccacaacatacgagccngaagcataaagtgtaaagcctggggggnctnatgagggagcta

SEQ ID NO: 593 - DNA, 600 bp, H. infleunzae
  misc_feature (509)..(509): n = a, c, g, or t
  misc_feature (516)..(516): n = a, c, g, or t
  misc_feature (525)..(525): n = a, c, g, or t
  misc_feature (543)..(543): n = a, c, g, or t
  misc_feature (545)..(545): n = a, c, g, or t
  misc_feature (560)..(561): n = a, c, g, or t
  misc_feature (575)..(575): n = a, c, g, or t
  misc_feature (580)..(580): n = a, c, g, or t
  misc_feature (586)..(588): n = a, c, g, or t
  misc_feature (592)..(592): n = a, c, g, or t
  misc_feature (595)..(595): n = a, c, g, or t
ttaacagaattgggacaactccagtgaaaagttcttctcctttactcatatgtatatctccttcttaaatctagaggatctatacctgcaattaaaataacgaaagtcatacccactgcaataatcgcattaaccgaagtttggcgtaaaatattcaaaatattatctacgctaaaaaaatcaggattaatcattgatacaatcgcgataagaataatcaacgcaataaaagaacgctgttcaatcaaaaatcttcctatttgaaaattagatgtttcatttttcatcatacttacctactcttatttaccaatagctgctgctaataatttttcttgagttgcgtctttgcgagaaaattctgcactaattttaccttcacgcattaccaacactctatcgctcataccaagcacttctggcatatcagatgagatcctctagagtcgacctgcaggcatgcaagcttggcgtaatcatggtcatagctgtttcctgtgtgaaattgntatccgntcacaattncacacaacatacgagccngnagcataaaggggaannccggggggcctaanggggngctacnnnattnatngggtg

SEQ ID NO: 594 - DNA, 600 bp, H. influenzae
  misc_feature (12)..(12): n = a, c, g, or t
  misc_feature (14)..(14): n = a, c, g, or t
  misc_feature (597)..(597): n = a, c, g, or t
aagtactctgtntntctccttcttaaatctagaggatcgggattatcaagcacattactcgtttggctttcacggaaagattgcaagcgtgaaagcaacttctgcatcccaacttgctagaatttgtgcggctaacaatccagcatttgccgcacccgcagggccaatagccaatgttccgactgggattccttttggcatttgcacaattgaataaaggctatctacgccacttaacatagaactttttactggcacacccagcacaggcacaagggttttggctgcgatcatgccgggtaaatgtgccgcaccgccagccccagcaataattactttatagccatttttttgtgcattttcagcaaattcaaaaagtttatcaggcgtacgatgagcagagacgatttccacatgataaggtacttttaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatntat

SEQ ID NO: 595 - DNA, 600 bp, H. influenzae
  misc_feature (6)..(6): n = a, c, g, or t
  misc_feature (11)..(11): n = a, c, g, or t
  misc_feature (46)..(46): n = a, c, g, or t
ttatgngaccntgggacaagtccagtgaaaagttcttctcctttantcatatgtatatctccttcttaaatctagaggatcttcatcatctaaaactaatacgccagttccatgtttgaaagcattaattgcattaagtacgcgttcttcagcggtgttgccgaatggagataaaattgactgattcatagtaatttcctaatttgagatttcaattaaataccagaatcagggctgagaaatgcaaataaaatgaacgatttgggaacccaactcgttttattctctttcatccagactttactgtcggctttggaatttcaccaaatctgctgactttaaaagtgaaaatcaggacaatttcgcaggaaaaatttgccaaaaattgaccgcacttttaaacgctcgtgggctttaccaccggtagggaatttcaccctgccctgagaatgcgagctaagtataacgcaaaatacctaggcactaaatcagaacgtgaaaaatattttcatttagcctacaataaacacactcaattcttacgctatcaagagcagattatgtcaaaaacaaaagagaaaaaagtcggtgtcattttcg

SEQ ID NO: 596 - DNA, 600 bp, H. influenzae
  misc_feature (2)..(2): n = a, c, g, or t
  misc_feature (7)..(7): n = a, c, g, or t
  misc_feature (435)..(435): n = a, c, g, or t
  misc_feature (446)..(446): n = a, c, g, or t
  misc_feature (458)..(458): n = a, c, g, or t
  misc_feature (463)..(463): n = a, c, g, or t
  misc_feature (475)..(475): n = a, c, g, or t
  misc_feature (478)..(478): n = a, c, g, or t
  misc_feature (497)..(497): n = a, c, g, or t
  misc_feature (511)..(511): n = a, c, g, or t
  misc_feature (517)..(517): n = a, c, g, or t
  misc_feature (523)..(523): n = a, c, g, or t
  misc_feature (534)..(534): n = a, c, g, or t
  misc_feature (561)..(562): n = a, c, g, or t
  misc_feature (565)..(565): n = a, c, g, or t
  misc_feature (582)..(582): n = a, c, g, or t
  misc_feature (595)..(595): n = a, c, g, or t
  misc_feature (600)..(600): n = a, c, g, or t
tnacagnaattgggacaactccagtgaaaagttcttctcctttactcatatgtatatctccttcttaaatctagaggatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaaataatctaactctttattgttatttgtttgatttctaatagtagatgaatttaaacgaaaatatgttttagtttatttttgatgaagaggaatgngtctatctatncttaataaaagngcggntatttttattgnagnttttaatatattgatcctntagagagcgacccncacgcntgcgcncttggggcgancatggggcatatagttgttccctgtgnnaangtgttatccgttcacanttccccacaaaanacgan

SEQ ID NO: 597 - DNA, 600 bp, H. influenzae
  misc_feature (6)..(6): n = a, c, g, or t
  misc_feature (394)..(394): n = a, c, g, or t
  misc_feature (442)..(442): n = a, c, g, or t
  misc_feature (451)..(451): n = a, c, g, or t
  misc_feature (480)..(480): n = a, c, g, or t
  misc_feature (493)..(493): n = a, c, g, or t
  misc_feature (498)..(498): n = a, c, g, or t
  misc_feature (506)..(506): n = a, c, g, or t
  misc_feature (508)..(508): n = a, c, g, or t
  misc_feature (512)..(512): n = a, c, g, or t
  misc_feature (515)..(515): n = a, c, g, or t
  misc_feature (521)..(521): n = a, c, g, or t
  misc_feature (553)..(553): n = a, c, g, or t
  misc_feature (578)..(579): n = a, c, g, or t
aacagnattgggacaactccagtgaaaagttcttctcctttactcatatgtatatctccttcttaaatctagaggatcagtacgagtccagtctaaaacaggcataaaattgtaacaaacagtgtcaattccgcattgagcaagcattgcgagagagtttgtttatagttattaatccatttttgataatttccagtactgagttttaatctcttcatgaactggtacactttccactactgaccagcttaaaccagcattctctatttcagttttgcagttttttaatttcttcgatactccacacttcaccgttaggaatatggtgaagtgcagtgactataccagttgcgcctgcttgacgaatatcagataaagaaacaggatcctctanagtcgacctgcaggcatgcaagcttggcgtaatcatggtcatagctgnttcctgtgngaaactggtatccgctcacaattccaccnaacatacgagccngaagncataaagngntaanccntggggngcctaatgagtgagctaactcacattaattgngttgggcttactgcccgttttcagnngggaaacctggcgcgccagct

SEQ ID NO: 598 - DNA, 600 bp, H. influenzae
  misc_feature (2)..(2): n = a, c, g, or t
  misc_feature (8)..(8): n = a, c, g, or t
tnacaagnaattgggacaactccagtgaaaagttcttctcctttactcatatgtatatctccttcttaaatctagaggatcaacctcgtaacttagcaaaatcagttaccgttgaataaagtgcggttgattttaatgtaataaaaaaaacggtgaaatttcaccgtatttttttagttaaataatcttctttgtttccgtgttttaatcacttgtgcgattaacaataatgtgagaataaccacatatagtgaaaaaataaccactagccattgcaccatcgttaaaccaaataatgaccattggctttcattacaagagccagttgggttaaatataaatggaaaccattgatgaaatggtaaagtctcgggaaaatttggaataaactcacattgtttccaaggagctggattcatttgcaaatcaagatgacgaaatgaaatcaataagcccttaatactgctgaataaacctaaagccaaggcgattaatcgaagtatgaaagcaagaggttgaagtaatgcaataatgcccgctacaaataagccaatcattgctaaacgttcataaacacagagcacacaaggttgtaagccc

SEQ ID NO: 599 - DNA, 600 bp, H. influenzae
  misc_feature (1)..(1): n = a, c, g, or t
nacaagattgggacaactccagtgaaaagttcttctcctttactcatatgtatatctccttcttaaatctagaggatcgcccgccagcaccccaggggaggaggacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtaggggctaattacattagccccgatatttcaccaataattgggcaaatgtaatttgcccctacgattaacgaaccaaagatgcaggttcttccacattcttcaacaacgcatatttttcgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcatt

SEQ ID NO: 600 - DNA, 600 bp, H. influenzae
  misc_feature (3)..(3): n = a, c, g, or t
  misc_feature (9)..(9): n = a, c, g, or t
  misc_feature (495)..(495): n = a, c, g, or t
  misc_feature (498)..(498): n = a, c, g, or t
  misc_feature (538)..(538): n = a, c, g, or t
  misc_feature (600)..(600): n = a, c, g, or t
tanacaagnaattgggacaactccagtgaaaagttcttctcctttactcatatgtatatctccttcttaaatctagaggatccaatctcaatacgtattacttgcccattactatttaaaatcggtagccattcattgtgcgttttagaacggataaccgtgaaatatttgctgtgtgatggtttcgttagaaaaatattacgattaagcactacatccgcatcaataacataacaatcactaaagaagtcttgtgccagagaaaaggaataaatgctgttatattcgcgatatttttcgttgtaaatcaaggtgcagtcatattttttctttagatactcgaattgttcgtgtaaataccctgtaacaatgacaatattgtcgatatttgcttgacgtagaaaagtgagtgtccgttctaagttaggtgtgccgtgaatatctaacaatgatttatgtgtgctttgtgtgatgtctttaaaacgaccggcttantcntgcagctaaaataatcgcattcatttttgttcccctttgnaaaaaagtgtaccgatcctctagagtcgacctgcaggcatgcaagcttggcgtaatcatggn

SEQ ID NO: 601 - DNA, 600 bp, H. influenzae
  misc_feature (2)..(2): n = a, c, g, or t
  misc_feature (9)..(9): n = a, c, g, or t
tnacaaganttgggacaactccagtgaaaagttcttctcctttactcatatgtatatctccttcttaaatctagaggatcgctcattcgagagacacctccaacagcacgaatatctgcaggaattcgttccaaagccatcactgcagctgcaccagcagcttctgcaatgcgagcttgttcagggttttgaacatccatgataacaccacctttgagcatctgtgctaagtttttatttagttcataacgattttcagccatttctttgtcctcattatttggttatttgtattgatagctacgttttttattgtaatgtagaaaagtctttagaacaagtttgaaaaaatgcgtatatattaaaaggcataatgtctagtgtgcttaatttcagttttttgtataaacgaagtgtagaacgtcagaaggattgtccaatttaataatagaaaaaagagctactttagctgaaagaatttcgtccttaagtgccacaatagttattaaaaaaaccttgaaatgtttttaaaaacctttttctatgtggttagattttctgaaatttaagaaaaagcttgaaagggagtttacgctttcc

SEQ ID NO: 602 - DNA, 600 bp, H. influenzae
  misc_feature (3)..(3): n = a, c, g, or t
  misc_feature (544)..(544): n = a, c, g, or t
  misc_feature (561)..(561): n = a, c, g, or t
ttnacaaggaatcgggacaactagcagtgaaaagttcttctcctttactacatatgtatatctccttcttaaatctagaggatctgcaaaattgttgcaaccactaatacgatggctgcttcacgtacaccaccgagtttgtaagtgataaaaaataaaattaaagggataaagtcaaggagttgtttcatattgattaatccttcataaataagctgtagaaacgataagtcactactagcatgaaaatattaagtaatgcggtgaaaatgcctattaccatatcaaatatagcattattggaaaatgcgcttaattggaaaataagaattggcacgagaaaataaaccagtagggtgtaaataaacaatacgccttttcgagtatttcctcgcatccaaatttttcggatagtttgcgaaagtgcctcttgagtagaaagataatgtactaccgttaaattttaaacggacaaagaaccaaacgccaacaagcatcgcgataagtgacataatagagggcgatttttttgtgagtaatgcancaaaggcttcaccaagnaccagtaacattggtgcaaccattaatagatcctcttag

SEQ ID NO: 603 - DNA, 600 bp, H. influenzae
  misc_feature (1)..(1): n = a, c, g, or t
  misc_feature (8)..(8): n = a, c, g, or t
nacaaganttgggacaactccagtgaaaagttcttctcctttactcatatgtatatctccttcttaaatctagaggatccttgaaacatcacctcagatttaatcaatctgtggattctatccaagaaaagtaccacgaaattttctctttcctcattacctataatggtttgaaaatagagtttagctattgatggctcagtaaattcctgtgcaccttggtaaaagggcttttcttccatcactttagttaaaataacctgtgcctgttctaaaatagcttgttgttgctcgtttaatttaaacattcgatattccttctaaaatagggaatatcgcccataagggatatatcccctatgggtaaggtgcgaaaagaatgcttatcgcacattaaagttaatgttattaatcagaagtttttaaactgtcgataatctgtttaatttttgctgcaaattctaaatcgtgctcagattcatcatctatacaatattccaaataattactcatatcagcaattagtgcttcttttgttggcgaaggttggaacataattgatcctctagagtcgacctgcaggcatgcaagcttggcgta

SEQ ID NO: 604 - DNA, 600 bp, H. influenzae
  misc_feature (9)..(9): n = a, c, g, or t
  misc_feature (570)..(570): n = a, c, g, or t
  misc_feature (577)..(577): n = a, c, g, or t
  misc_feature (581)..(581): n = a, c, g, or t
  misc_feature (586)..(586): n = a, c, g, or t
  misc_feature (597)..(597): n = a, c, g, or t
  misc_feature (599)..(599): n = a, c, g, or t
ttaacaagnaattgggacaactccagtgaaaagttcttctcctttactcatatgtatatctccttcttaaatctagaggatcggcttctaacatttcgccgtctaaacgttcgttgttataaattgcaatcgccagcaggaaaaccaagcgttcggtaggtaaattcaaagaaaactcgcgatcttttgcccaagagacgagttcaggaatagtttgggatgtttcaatcattgaattgcaaagcgttaaaattgaacaaaaaattggaaagattatacaggattttttgcggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggnctccatngganaaacngtcccagggtntnt

SEQ ID NO: 605 - DNA, 600 bp, H. influenzae
  misc_feature (7)..(7): n = a, c, g, or t
  misc_feature (561)..(561): n = a, c, g, or t
  misc_feature (572)..(572): n = a, c, g, or t
taacagnattgggacaactccagtgaaaagttcttctcctttactcatatgtatatctccttcttaaatctagaggatccacgtaatcagaattttctgcagaagatggcgatgccgcaccaccgtgatggcggcgaattaaatctaactccgccaaaatattcaaatcacgacgaatcgtttgagggctaacatctaaggcagcaaccaattcttccgtgcttaaatagccagattgttccaccagtttaataattttttgatggcgtaacgattgtttcatagcgaatcctttatccaaattaaacggacttactctagcgaatttttgcgcaatttgctatcaataaatccccaaatcaagccgacaatcaagcctgaaatatgtgcagcatttcccatttcaacaccaaataaggggctaataaaacctaatgcgatcctctagagtcgacctgcaggcatgcaagcttggcgtaatcatggtcatagctgtttcctgtgtgaaattgttatccgctcacaattccacacaacatacgagccggaagcataaagtgnaagcctggggngcctaagggtgagctaactcacattatt

SEQ ID NO: 606 - DNA, 600 bp, H. influenzae
  misc_feature (580)..(580): n = a, c, g, or t
taacaagaattgggacaactccagtgaaaagttcttctcctttactcatatgtatatctccttcttaaatctagaggatcaccattttcaagagattgagaaataaactctaaaatatcttttaccatattttcaatttcttttgcagataaagttggctgttttgctgacaatttttccataagttctgacttagtcatcctctatacttccttaatattatttaaattaagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggcctccatcggagaaactgtccgaggttatgttgacctgcaggggggggggggcccctgaggtctgcctcgngaagaaggggttgctgactc

SEQ ID NO: 607 - DNA, 600 bp, H. influenzae
  misc_feature (1)..(1): n = a, c, g, or t
  misc_feature (6)..(7): n = a, c, g, or t
  misc_feature (378)..(380): n = a, c, g, or t
  misc_feature (402)..(402): n = a, c, g, or t
  misc_feature (405)..(405): n = a, c, g, or t
  misc_feature (407)..(407): n = a, c, g, or t
  misc_feature (411)..(412): n = a, c, g, or t
  misc_feature (430)..(433): n = a, c, g, or t
  misc_feature (439)..(439): n = a, c, g, or t
  misc_feature (445)..(445): n = a, c, g, or t
  misc_feature (452)..(452): n = a, c, g, or t
  misc_feature (455)..(455): n = a, c, g, or t
  misc_feature (459)..(459): n = a, c, g, or t
  misc_feature (481)..(481): n = a, c, g, or t
  misc_feature (486)..(486): n = a, c, g, or t
  misc_feature (492)..(492): n = a, c, g, or t
  misc_feature (503)..(503): n = a, c, g, or t
  misc_feature (512)..(512): n = a, c, g, or t
  misc_feature (519)..(519): n = a, c, g, or t
  misc_feature (529)..(529): n = a, c, g, or t
  misc_feature (537)..(537): n = a, c, g, or t
  misc_feature (539)..(539): n = a, c, g, or t
  misc_feature (544)..(544): n = a, c, g, or t
  misc_feature (546)..(546): n = a, c, g, or t
  misc_feature (548)..(548): n = a, c, g, or t
  misc_feature (552)..(552): n = a, c, g, or t
  misc_feature (561)..(561): n = a, c, g, or t
  misc_feature (576)..(576): n = a, c, g, or t
  misc_feature (579)..(579): n = a, c, g, or t
  misc_feature (582)..(582): n = a, c, g, or t
  misc_feature (584)..(584): n = a, c, g, or t
  misc_feature (597)..(597): n = a, c, g, or t
nacagnnttgggacaactccagtgaaaagttcttctcctttactcatatgtatatctccttcttaaatctagaggatcaacatctaagacaagattttttaatggactactggtattgggaacacttaattcatttggtaagcaatagaccatttccatttttgtattacgagtgcgaaccgcaccaaatttgctgagcattctcgatatttttgattgattaataccagtaaagccttgtttttttaaggcatcgacaatttcattttgagaaccaaagcgttcttgattgagtaattctttaaaagcacgagttaaattgtcagtcatctttattttttaatagtcaaaatttgcataagaattgcataaaaattnnnctttcatcaactggaatatggnttngnaccnnggggaagaaatttttttnnnnaaaatnggaacnagatccnttnaagncaacctgcaggcatgcaagctnggcgnaatcanggcatagctgnttcctgggnaaattgntatccgttanaattcccncnacatncnanccgnagcataagngaaagcctgggggcntangangnggctacccccatnatt

SEQ ID NO: 608 - DNA, 600 bp, H. influenzae
  misc_feature (454)..(454): n = a, c, g, or t
  misc_feature (459)..(459): n = a, c, g, or t
  misc_feature (517)..(517): n = a, c, g, or t
  misc_feature (523)..(523): n = a, c, g, or t
  misc_feature (542)..(543): n = a, c, g, or t
  misc_feature (550)..(550): n = a, c, g, or t
  misc_feature (566)..(566): n = a, c, g, or t
  misc_feature (576)..(576): n = a, c, g, or t
  misc_feature (588)..(589): n = a, c, g, or t
  misc_feature (592)..(592): n = a, c, g, or t
  misc_feature (595)..(595): n = a, c, g, or t
  misc_feature (599)..(599): n = a, c, g, or t
tttaacaaggaatccgggcacaactaccagtgaaaagttctctctcctttactcatatgtatatctccttcttaaatctagaggatcctttatcgctgtggagaacttcaaattgtactttttgacctgcttttaatgaacgatagccgtccatttcaatcactgaataatgtgcaaaaatatcggcatctacaccttctgcggaaatgaaaccaaatccttttgcattattgaaccattttacaataccaatttccataaaagacctctctaggcttagcctattaaaacaataaatcaacaagactctcgccttatcacctactaattaggtccgttatgtttaaatattttgaacggttatgcaacgagcaatattcaaaaatgataagtagatcctctagagtcgacctgcaggcatgcaagcttggcgtaatcatggtcatagctgttncctgngtgaaattgttatccgctcacaattccacacaacatacgagccggaagcataaagtgntaagcntggggtgcctaatgagtgnnctaactnacataaattgagttangctcactgcnccgttttccagnnggnganaccng

SEQ ID NO: 609 - DNA, 600 bp, H. influenzae
taacagcattgggacaactccagtgaaaagttcttctcctttactcatatgtatatctccttcttaaatctagaggatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccattttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcctcta

SEQ ID NO: 610 - DNA, 600 bp, H. influenzae
  misc_feature (3)..(4): n = a, c, g, or t
  misc_feature (10)..(10): n = a, c, g, or t
  misc_feature (294)..(294): n = a, c, g, or t
  misc_feature (370)..(370): n = a, c, g, or t
  misc_feature (387)..(387): n = a, c, g, or t
  misc_feature (481)..(482): n = a, c, g, or t
  misc_feature (489)..(489): n = a, c, g, or t
  misc_feature (492)..(493): n = a, c, g, or t
  misc_feature (501)..(501): n = a, c, g, or t
  misc_feature (503)..(503): n = a, c, g, or t
  misc_feature (519)..(519): n = a, c, g, or t
  misc_feature (523)..(523): n = a, c, g, or t
  misc_feature (532)..(532): n = a, c, g, or t
  misc_feature (544)..(544): n = a, c, g, or t
  misc_feature (549)..(549): n = a, c, g, or t
  misc_feature (551)..(551): n = a, c, g, or t
  misc_feature (565)..(565): n = a, c, g, or t
  misc_feature (567)..(567): n = a, c, g, or t
  misc_feature (574)..(574): n = a, c, g, or t
  misc_feature (585)..(585): n = a, c, g, or t
  misc_feature (587)..(587): n = a, c, g, or t
  misc_feature (592)..(592): n = a, c, g, or t
ttnnacaagnaattgggacaactccagtgaaaagttcttctcctttactcatatgtatatctccttcttaaatctagaggatcatcaagataatcaagtacatattgttcaatttgaggaatgcgatttagacttggcaacatagtatttaactcatttaaaggtaaaaatggcaggttattgataatatcttaaggcgttaatgatgtcgaattagattttgagcatttttaaggagtgttttatggagtaaatgagtcaagaaaagtgtgttgtttggatgaaaaataaacnaaaaattcaaaagaatttgatcctctagagtcgacctgcaggcatgcaagcttggcgtaatcatggtcatagctgnttcctgtgtgaaattgntatccgctcacaattccacacaacatacgagccggaagcataaagtgtaaagcctggggtgcctaatgagtgagctaactcacattaattgcgnngcgctcnctnncccctttncncaggggaaaaccctgncgcnccagctgcntttaatgaatcngcccncncgcggggaggggcngnttgcgtnttgggcgccanancccgnctccatcg

SEQ ID NO: 611 - DNA, 600 bp, H. influenzae
  misc_feature (1)..(1): n = a, c, g, or t
  misc_feature (7)..(7): n = a, c, g, or t
  misc_feature (555)..(555): n = a, c, g, or t
  misc_feature (571)..(571): n = a, c, g, or t
nacaagnaattgggacaactccagtgaaaagttcttctcctttactcatatgtatatctccttcttaaatctagaggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgntttccagtcgggaaancctgtcgtgccagctgcattaatgaatcg

SEQ ID NO: 612 - DNA, 600 bp, H. influenzae
  misc_feature (4)..(5): n = a, c, g, or t
  misc_feature (11)..(11): n = a, c, g, or t
  misc_feature (456)..(456): n = a, c, g, or t
attnnacaagnaattgggcacaactccagtgaaaagttcttctcctttactcatatgtatatctccttcttaaatctagaggatcatctttgataataagctgtaattttggttgaaaacctgaaatgctcatcccttgctgtttttggggtttcactgtaataaattcttggcgagaaaagggcaattcaggattaaaatgtttattgcctgtaagatagtgtaaaccttttgtgctgtaaccagaatgaacttcattttttttcaatggctttaataaaatacgacaaaaattcattgtttttcttcctgaatttgcactgcgcctaacatattttccccgttattaagtaaaaagcgaaacatatcgctttcatcaattcgttgatgaagtgcatatttgtgttttagccagccttctgggacgagggatgcaaaataagggaataaggtgtnagaatgaaaaggactttgctcaataggaaagctgagagagagcggtattccttgataatcgggattgtaagcaaaatgaaaacctcgatgatcctctagagtcgacctgcaggcatgcaagcttggcgtaatcatggtcatagc

SEQ ID NO: 613 - DNA, 600 bp, H. influenzae
  misc_feature (1)..(1): n = a, c, g, or t
  misc_feature (6)..(6): n = a, c, g, or t
  misc_feature (412)..(413): n = a, c, g, or t
  misc_feature (456)..(457): n = a, c, g, or t
  misc_feature (460)..(461): n = a, c, g, or t
  misc_feature (467)..(467): n = a, c, g, or t
  misc_feature (470)..(470): n = a, c, g, or t
  misc_feature (472)..(472): n = a, c, g, or t
  misc_feature (474)..(474): n = a, c, g, or t
  misc_feature (487)..(488): n = a, c, g, or t
  misc_feature (491)..(491): n = a, c, g, or t
  misc_feature (532)..(532): n = a, c, g, or t
  misc_feature (543)..(543): n = a, c, g, or t
  misc_feature (552)..(552): n = a, c, g, or t
  misc_feature (567)..(567): n = a, c, g, or t
  misc_feature (571)..(571): n = a, c, g, or t
  misc_feature (576)..(576): n = a, c, g, or t
  misc_feature (578)..(578): n = a, c, g, or t
nacagnattgggacaactccagtgaaaagttcttctcctttactcatatgtatatctccttcttaaatctagaggatcactgcattgagtaaacgactttgtgattcaatattattttcgagtgcagtcaggcgaaaataggtttcgattaaatacataaattttttaattgctgtctgatttggtttaagccgtttaaacgcatttcacttaaacgttgtgaaatgccgagttcgctaaaaaaggcaataatatcaaatgtattcaattcatccgctgttttgccattgatttgattgaataaaatccaaagcaagccattcataattctggcttcgctaaatccgctgaattgaaaagtgcggtcatgtttaggcataatttgaaaccacatttgtgcttcgcagccagnnaataggttgcatttgagcgagttcattatcgcttgggcgaggnnaannttttgnctncncnggaaaaatcaggnnatngcgatcctttagagtcgacctgcaggcatgcaagcttggcngtaatcatggncatagctgnttcctgggggaaatngttntccgntncaattccccacaacatacgagc

SEQ ID NO: 614 - DNA, 600 bp, H. influenzae
caagacttgggacaactccagtgaaaagttcttctcctttactcatatgtatatctccttcttaaatctagaggatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaa

SEQ ID NO: 615 - DNA, 1089 bp, H. influenzae
atgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacaaattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcagatttggctagatgaagctggtgtaaatgaaatcaaaactggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccattggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgattcatttaaatgtcacgggtaataacgatcatcataaaatagagagcttatttaaagcctttgggagaacattaagacaggcgattcggattgaaggaaatgaaatgccaagttcaaaaggagttttatag

SEQ ID NO: 616 - protein, 362 aa, H. influenzae
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQIWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATIHLNVTGNNDHHKIESLFKAFGRTLRQAIRIEGNEMPSSKGVL

SEQ ID NO: 617 - DNA, 1695 bp, H. influenzae
atgttacgtctaaatctgagatttttatcttttctgctctgtataagccaaagtgtagaattacaggctgcgccaagtgttccaacatttttaactgaaaatggcttaacttattgcacccacgcttcaggtttttcatttaatccgcaaacagcagatgcaggaaccagtatgaatgtggtcacggaacaaatttataacaaattatttgatataaaaaatcacagtgcaacattaacaccaatgctggcacaatcttattccatttcagctgatggtaaagaaattttattaaatttacgtcacggcgtaaaatttcaccaaaccccttggtttaccccaacacgtgattttaacgctgaagacgtagtattttcgattaatcgtgtattagggcataatacttatttaccaaccttagcagaggcgaatgttacctatagtaatccacaatatagagtgtttcacgaacaagcaagaaaagtgcgttttccttattttgatagcattaaacttaacgaaaaaatcaaatctgtgaccgcactttcgccttatcaagtaaaaattgaattatttgcaccagattcctccattttgtcgcatcttgccagccagtatgccattattttttcacaagaatatgcctatcaattaagcgcagatgacaaccttgctcaattagatacccacccagtaggcacagggccttatcaagtaaaagattatgtatataaccaatatgttcgcttagtgcgtaacgaaaactattggaaaaaagaagccaagatagaacatattattgtggatctttctactgatcgcagcggacgtttagtcaaatttttcaataatgaatgtcaaatcgcctcttatcctgaagtaagccaaattggcttattaaaaaatgatgacaaacattattatatgcaatctactgatggtatgaatttagcctatttagcgtttaattttgataagccattaatgcgagatcacgaaatccgtgctgctatttcacaaagtttaaaccgagctcgaatcattcatagcatttaccataacacagcaactgttgctaataacattattcctgaagtgtcttgggcttcaactgtcaatacgccagaatttgagtttgattaccatcccaaaatcgccaaaaataaattagcagataaaaaccttttgttaaatttatgggtaattaatgaagaacaagtctataatccagcaccttttaaaatggctgaaatgatcaaatgggatttagctcaagcgggtgtgaaagttaaagtgcgtgccgtaactcgtccatttttaactgcacaattacgcaatcaatcggaaaattatgatttgattctatctggttggttagctggtaatcttgatcctgatggttttatgcgtccaattttaagctgtggaacaaaaaatgaactcactaatttatctaattggtgtaatgaagaatttgatcaatttatggatcgtgccattaccacctcacatttaagttcacgcgcaaaagcctataatgaagcccaagaactcgttttacgtgaattacccattattcctattgccaatgtaaaacgaattttagtcgcaaatagtcgtgtgaaaggagtaaaaatgacgccttttggtagcttagatttttccaccttatattttattcaggagaaacactaa

SEQ ID NO: 618 - protein, 564 aa, H. influenzae
MLRLNLRFLSFLLCISQSVELQAAPSVPTFLTENGLTYCTHASGFSFNPQTADAGTSMNVVTEQIYNKLFDIKNHSATLTPMLAQSYSISADGKEILLNLRHGVKFHQTPWFTPTRDFNAEDVVFSINRVLGHNTYLPTLAEANVTYSNPQYRVFHEQARKVRFPYFDSIKLNEKIKSVTALSPYQVKIELFAPDSSILSHLASQYAIIFSQEYAYQLSADDNLAQLDTHPVGTGPYQVKDYVYNQYVRLVRNENYWKKEAKIEHIIVDLSTDRSGRLVKFFNNECQIASYPEVSQIGLLKNDDKHYYMQSTDGMNLAYLAFNFDKPLMRDHEIRAAISQSLNRARIIHSIYHNTATVANNIIPEVSWASTVNTPEFEFDYHPKIAKNKLADKNLLLNLWVINEEQVYNPAPFKMAEMIKWDLAQAGVKVKVRAVTRPFLTAQLRNQSENYDLILSGWLAGNLDPDGFMRPILSCGTKNELTNLSNWCNEEFDQFMDRAITTSHLSSRAKAYNEAQELVLRELPIIPIANVKRILVANSRVKGVKMTPFGSLDFSTLYFIQEKH

SEQ ID NO: 619 - DNA, 972 bp, H. influenzae
atgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaa

SEQ ID NO: 620 - protein, 323 aa, H. influenzae
MMKNETSNFQIGRFLIEQRSFIALIILIAIVSMINPDFFSVDNILNILRQTSVNAIIAVGMTFVILIAGIDLSVGSVLALTGAIAASMVSIELPIFLVIPVVLLIGTLLGGISGVIVAKGKVQAFIATLVTMTLLRGITMVYTDGRPITTGFSDNADLFASIGTGYVLGIPVPIWIMSIVFAVAWYILKHTPIGRYIYALGGNEAATQLSGINVNKIKVFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKL

SEQ ID NO: 621 - DNA, 495 bp, H. influenzae
atgtcaaaaactgcacaaattgctgttgtgatgggttccaaaagcgattgggctaccatgcaagaggcaactcagattttagatgaattaaaagtaccttatcatgtggaaatcgtctctgctcatcgtacgcctgataaactttttgaatttgctgaaaatgcacaaaaaaatggctataaagtaattattgctggggctggcggtgcggcacatttacccggcatgatcgcagccaaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataa

SEQ ID NO: 622 - protein, 164 aa, H. influenzae
MSKTAQIAVVMGSKSDWATMQEATQILDELKVPYHVEIVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELLSRLQSFRESQTSNVLDNPDPRT

SEQ ID NO: 623 - DNA, 648 bp, H. influenzae
atgaatcagtcaattttatctccattcggcaacaccgctgaagaacgcgtacttaatgcaattaatgctttcaaacatggaactggcgtattagttttagatgatgaagatcgtgaaaatgaaggcgatttaattttcccagcagaaacaatcacgtcagaacaaatggcaaaattaattcgttatggcagtggtatagtttgtttatgcattactgatgaacgttgccaacaactcgatttaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaa

SEQ ID NO: 624 - protein, 215 aa, H. influenzae
MNQSILSPFGNTAEERVLNAINAFKHGTGVLVLDDEDRENEGDLIFPAETITSEQMAKLIRYGSGIVCLCITDERCQQLDLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 625 - DNA, 1005 bp, H. influenzae
atggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggcataa

SEQ ID NO: 626 - protein, 334 aa, H. influenzae
MAFNMKNRHLLSLVHHTEREIKYLLDLSRDLKRAKYAGTEQQKLKGKNIALIFEKTSTRTRCAFEVAAYDQGAQVTYIDPNSSQIGHKESMKDTARVLGRMYDGIEYRGFKQSIVQELADYAGVPVFNGLTDEFHPTQMLADVLTMIEHCDKPLSEISYVYIGDARNNMGNSLLLIGAKLGMDVRICGPKALLPEANLVEMCEKFAKESGARITVTEDIDKAVKGVDFIHTDVWVSMGEPLETWGERIKLLLPYQVTPELMKRTGNPKVKFMHCLPAFHNSETKVGRQIAEKYPELANGIEVTEEVFESPMNIAFEQAENRMHTIKAVMVASLA

SEQ ID NO: 627 - DNA, 1185 bp, H. influenzae
atggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaaacgcaaaactgaaatagagaatgctggtttaagctggtcagtagtggaaagtgtaccagttcatgaagagattaaaactcagactggaaattatcaaaaatggattaataactataaacaaactcttcgcaatcttgctcaatgcggaattgacactgtttgttacaattttatgcctgttttagactggactcgtactgatctcgcttatgaattaccagatggttctaaagcattgcgctttgatcatatcgctttcgcagcatttgaacttcatattttaaaacgtcctgatgcagaaaaagcctataatcaagaagaacaagttgcagcaagaacctattatgacaagatgtcagagcaagatataacgcaattaacgcgtaatattattgcgggcttacccggtgcagaagaaggttatactcttgatgaatttcaaactcaattagatcgctataaagatatttcacccgaaaaattccgtacgcatttggcttattttttaaatgagatcgtacctgttgcccaagaagtaggaatcaaaatggcgattcatccagatgatcctccacgcccaatcttaggcttaccgcgcatagtttcaactattgaagatatgcaatggtttgtagaaactcaaccattaccagcaaatggttttacaatgtgtacgggttcttatggcgtacgctccgataatgatctcgtaaaaatgacagaacaatttgcagatcgtatttacttcgcacatttacgttctactcaacgtgaagataatccactaaccttccatgaagcagctcatctagaaggagacgtagatatgtttaatgtggtaaaagccttattaaatgaagaatatcgtcgattaaatcaaggagaaacgcgtttaatcccaatgcgcccagatcatgggcatcaaatgttggatgacttacgtaaaaaaaccaaccctggctactctgccattggtcggttaaaaggtctagctgaatttcgcggtttagagatggcactaaaaaaagtgtatttcaataagtaa

SEQ ID NO: 628 - protein, 394 aa, H. influenzae
MEQAWRWYGPKDPVSLSDIRQAGATGIVTALHHIPNGEVWSIEEIKKRKTEIENAGLSWSVVESVPVHEEIKTQTGNYQKWINNYKQTLRNLAQCGIDTVCYNFMPVLDWTRTDLAYELPDGSKALRFDHIAFAAFELHILKRPDAEKAYNQEEQVAARTYYDKMSEQDITQLTRNIIAGLPGAEEGYTLDEFQTQLDRYKDISPEKFRTHLAYFLNEIVPVAQEVGIKMAIHPDDPPRPILGLPRIVSTIEDMQWFVETQPLPANGFTMCTGSYGVRSDNDLVKMTEQFADRIYFAHLRSTQREDNPLTFHEAAHLEGDVDMFNVVKALLNEEYRRLNQGETRLIPMRPDHGHQMLDDLRKKTNPGYSAIGRLKGLAEFRGLEMALKKVYFNK

SEQ ID NO: 629 - DNA, 534 bp, H. influenzae
atgctcgcgctattaaaacaattttccgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcattattgcattacttcaacctcttgctttcatacttcgattaatcgccttggctttaggtttattcagcagtattaagggcttattgatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaa

SEQ ID NO: 630 - protein, 177 aa, H. influenzae
MLALLKQFSEKRFVWFLLAFSSLALESTALYFQYGMGLQPCVLCVYERLAMIGLFVAGIIALLQPLAFILRLIALALGLFSSIKGLLISFRHLDLQMNPAPWKQCEFIPNFPETLPFHQWFPFIFNPTGSCNESQWSLFGLTMVQWLVVIFSLYVVILTLLLIAQVIKTRKQRRLFN

SEQ ID NO: 631 - DNA, 816 bp, H. influenzae
atgaacagcaaattatccctttccaccaaactttcctccagcggtaaaacccagcttgctgaatactttgcgacgccaccgtttaaagtgataacgttgccaagttacgatgatgcgtgggcgaatggcttgaatgcgatgcagatgtcctcctcccctggggtgctggcgggcgatctgttagagattgatatttcgttggcaaaattgaccgcactttctttaaatacgcaggcatttactcgggtgcaggcgatgaatgaaggcgacagtgcgatgcaaacaacccatattttgcttgcggaaaacagtcgtttattctatttgccgcatccgttggtgttacataaagattccgtttttaagcagcaaacccagattgaaatgggcgaacaaagcgagctgatttacggtgaaatcgtggcgattgggcgggtgttgaatgatgaacgttttgccttccgccagttttcttcccatttgaagatttatactttgaaagacgatggcaaaaaacgaccgcttgtcagtgattgtatccagtggctgccgtctaaaatgaatcttaccgctttgagtcagatggaaaattattcccatcaaggttcgctgacttatctaaatttggcgaaaaataatgcggaaatcaaacaacaggtgcaagccttgcagcaacaaagtacggaagaaaaagatctactgataggcatatcacaactcaatgaatatggtttaatggtgcgggtactcgggtgtcgtgcagagcaaattcagaaattatttgagaaaattggtaggctattgaaatctgtgtaa

SEQ ID NO: 632 - protein, 271 aa, H. influenzae
MNSKLSLSTKLSSSGKTQLAEYFATPPFKVITLPSYDDAWANGLNAMQMSSSPGVLAGDLLEIDISLAKLTALSLNTQAFTRVQAMNEGDSAMQTTHILLAENSRLFYLPHPLVLHKDSVFKQQTQIEMGEQSELIYGEIVAIGRVLNDERFAFRQFSSHLKIYTLKDDGKKRPLVSDCIQWLPSKMNLTALSQMENYSHQGSLTYLNLAKNNAEIKQQVQALQQQSTEEKDLLIGISQLNEYGLMVRVLGCRAEQIQKLFEKIGRLLKSV

SEQ ID NO: 633 - DNA, 702 bp, H. influenzae
atgaatgcgattattttagctgcaggattaggcagtcgttttaaagacatcacacaaagcacacataaatcattgttagatattcacggcacacctaacttagaacggacactcacttttctacgtcaagcaaatatcgacaatattgtcattgttacagggtatttacacgaacaattcgagtatctaaagaaaaaatatgactgcaccttgatttacaacgaaaaatatcgcgaatataacagcatttattccttttctctggcacaagacttctttagtgattgttatgttattgatgcggatgtagtgcttaatcgtaatatttttctaacgaaaccatcacacagcaaatatttcacggttatccgttctaaaacgcacaatgaatggctaccgattttaaatagtaatgggcaagtaatacgtattgagattggatcattaaaccagtctagcttgtcaggggtatcttattggacaactcgggattgcgatatcattctaactttgctcaaagaatacacaagtgaagtgcggttaaaaaatccaaaactttattgggataccattccgatggaatatatagagaaattaaatatctatacggaacaacttaacagtgatgatatatttgaaatggataaccttgatgactatcaccacattttacaaaaattgacaccaaacaaggaaaaataa

SEQ ID NO: 634 - protein, 233 aa, H. influenzae
MNAIILAAGLGSRFKDITQSTHKSLLDIHGTPNLERTLTFLRQANIDNIVIVTGYLHEQFEYLKKKYDCTLIYNEKYREYNSIYSFSLAQDFFSDCYVIDADVVLNRNIFLTKPSHSKYFTVIRSKTHNEWLPILNSNGQVIRIEIGSLNQSSLSGVSYWTTRDCDIILTLLKEYTSEVRLKNPKLYWDTIPMEYIEKLNIYTEQLNSDDIFEMDNLDDYHHILQKLTPNKEK

SEQ ID NO: 635 - DNA, 876 bp, H. influenzae
atggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataa

SEQ ID NO: 636 - protein, 291 aa, H. influenzae
MAENRYELNKNLAQMLKGGVIMDVQNPEQARIAEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMSQEIRRIQNLREDELYVAAKDLQVPVELVQYVHKHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 637 - DNA, 558 bp, H. influenzae
atgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataa

SEQ ID NO: 638 - protein, 185 aa, H. influenzae
MKQLLDFIPLILFFITYKLGGVREAAIVLVVATILQIVILKWKYGIVEKQQKIMASAVVFFGLLTAYFNEIRYLQWKVTIINGLFAIVLLVAQFQFKTPLIKKLLGKELQLPEKAWNTLNLGWALFFIICMLVNIYISHNMSEEAWVDFKSFGIIGMTVIATIISGVYIYRYLPKDGSNSKDGEK

SEQ ID NO: 639 - DNA, 666 bp, H. influenzae
atggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttattataa

SEQ ID NO: 640 - protein, 221 aa, H. influenzae
MENNDELMPREKLLAFGAKALSDYELLAIFLRTGIKDCPVMSLSKNVLTHFGSLHALLSADKKAFCSVKGLGITQFIQLQAITEMTKRYLKQEMLSTPIINDLETVKLFLLTELQHEEREVFMVLFLDNQHRLIKKERLFLGTINVSAVYPREIIKEALYCNAAALILAHNHPSGITEPSYSDQLITKKIQDAAELMEIRVLDHLIVGKSDCYSFAENCLL

SEQ ID NO: 641 - DNA, 1335 bp, H. influenzae
atgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgttgcgtgaagatgatgctttaggtgaattaccagaagaattgcaatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatcgggtatttatccagattggcaagcaattaataaacgtggtgctgaagtgcaagcgcatgtgattgataagtattaa

SEQ ID NO: 642 - protein, 444 aa, H. influenzae
MIETSQTIPELVSWAKDREFSLNLPTERLVFLLAIAIYNNERLDGEMLEADLVDIFRHTMNAFEQSTDAIATRANNAINELVKQRLLNRFSSEFTEGLAIYRLTPLGVGVSDYYIRQREFSALRLSVQLSIVADEIQRASDSAEEGVENNESEHYWRRNVFAPLKYSVAEIFDSIDLSQRIMDENQQSIKDEIAELLTKDWQAAISSCERLLDETSGNLRELQDTLNAAGDKLQAQLLRIQDCVIGRDDLYFIDQLITDLQSKLDRIISWGQQAIDLWIGYDRHVHKFIRTAIDMDKNRVFSQRLRNSIHHYFEHPWFLWTAQAERLVDLRDEEMVLREDDALGELPEELQYESLSDLHDQIVEHMQGLLIAYRENNRPIDLSLVLKEQLENYPLSRHFDVARIIVDQAVRLGMANDDLSGIYPDWQAINKRGAEVQAHVIDKY

SEQ ID NO: 643 - DNA, 768 bp, H. influenzae
atgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaggaagttgcaaagttgattcctaacggtgcatcgttgtttattgatattggtacgacgccagaggctgttgccaatgcgttgcttggccacgaaaaactcagaattgtgacgaacaatctgaatgccgctcatcttttacgccaaaatgaaagttttgatattgttatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaa

SEQ ID NO: 644 - protein, 255 aa, H. influenzae
MKQSLRHQKIIKLVEQSGYLSTEELVAALDVSPQTIRRDLNILAELDLIRRHHGGAASPSSAENSDYVDRKQFFSLQKNNIAQEVAKLIPNGASLFIDIGTTPEAVANALLGHEKLRIVTNNLNAAHLLRQNESFDIVMAGGSLRMDGGIIGEATVNFISQFRLDFGILGISAIDADGSLLDYDYHEVQVKRAIIESSRQTLLVADHSKFTRQAIVRLGELSDVEYLFTGDVPEGIVNYLKEQKTKLVLCNGKVR

SEQ ID NO: 645 - DNA, 285 bp, H. influenzae
atgactaagtcagaacttatggaaaaattgtcagcaaaacagccaactttatctgcaaaagaaattgaaaatatggtaaaagatattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctagagtggatgttcaggcttaa

SEQ ID NO: 646 - protein, 94 aa, H. influenzae
MTKSELMEKLSAKQPTLSAKEIENMVKDILEFISQSLENGDRVEVRGFGSFSLHHRQPRLGRNPKTGDSVNLSAKSVPYFKAGKELKARVDVQA

SEQ ID NO: 647 - DNA, 456 bp, H. influenzae
atgactgacaatttaactcgtgcttttaaagaattactcaatcaagaacgctttggttctcaaaatgaaattgtcgatgccttaaaaaaacaaggctttactggtattaatcaatcaaaaatatcgagaatgctcagcaaatttggtgcggttcgcactcgtaatacaaaaatggaaatggtctattgcttaccaaatgaattaagtgttcccaataccagtagtccattaaaaaatcttgtcttagatgttgatcacaattcgatgttaatcgtaataaaaacgacgcccggtgctgctcaattaattgcacgattacttgattccattggaaaatcggaaggcattttaggcactatcgcaggcgatgatactatttttgtcacgcccacaaacgataaacctattgctgaattattgcaaaatatccaacgtttatttgaaaacgcattgtaa

SEQ ID NO: 648 - protein, 151 aa, H. influenzae
MTDNLTRAFKELLNQERFGSQNEIVDALKKQGFTGINQSKISRMLSKFGAVRTRNTKMEMVYCLPNELSVPNTSSPLKNLVLDVDHNSMLIVIKTTPGAAQLIARLLDSIGKSEGILGTIAGDDTIFVTPTNDKPIAELLQNIQRLFENAL

SEQ ID NO: 649 - DNA, 219 bp, H. influenzae
atggaaattggtattgtaaaatggttcaataatgcaaaaggatttggtttcatttccgcagaaggtgtagatgccgatatttttgcacattattcagtgattgaaatggacggctatcgttcattaaaagcaggtcaaaaagtacaatttgaagttctccacagcgataaaggatctcacgccacaaaaataatcccaattgcggatactcaagaataa

SEQ ID NO: 650 - protein, 72 aa, H. influenzae
MEIGIVKWFNNAKGFGFISAEGVDADIFAHYSVIEMDGYRSLKAGQKVQFEVLHSDKGSHATKIIPIADTQE

SEQ ID NO: 651 - DNA, 3084 bp, H. influenzae
atgttgccaagtctaaatcgcattcctcaaattgaacaatatgtacttgattatcttgatgatcttcaacaccaacattttgagggggatattgcgacaaattattcggatagattaagtctggctacggataacagcgtttaccaacagcttccacaggcgattctttttccgaaaactattgctgatatagtgcgtataaccaaattggcaaatttatctgaatatcaatcaatcagctttacgcctcgcggtggaggcactggcactaatggtcaatccatcaataacaatataatagtggatctttctcgtcatatgactgccatcttagaactcaatgtaaaagaacgttgggttaaagtacaagcaggtgtcgtaaaagatcaacttaatcaatttttaaaaccacatggtttattctttgccccagagctatccaccagcaatcgagcgactttaggcggaatgattaacacagatgcctcggggcaaggttcattgcaatacggtaaaacctctaatcatgttttggcattacgtgccgtattaatgaacggtgaaattttagatacaagtgcggtcaattctgttgatgttttagaaaacattgatgcgcttgaattaagtgagagcagcaaaagactccatcaaacaatcgcgcaacactgtaaagaaaaaagagcggcaatcattaaagatttaccacaacttaaccgttttttaacgggatacgatctcaaaaatgtattcaatgaagatgaaagtgaatttaatctcacgagaattctcactggttctgaaggttctctcgcatttatttgcgaagccaaactcaatcttctgcctattccgcagtatcgcacgctcatcaatattaaatatcgttcttttgacgcggcattacgcaatgcaccttttatggtgaaagccaatgcgctttctgtggaaaccgttgattccaaagtcttaaacctcgccaaacaagatattatttggcattctgtgaatgaacttcttacagaagatgaaaaagatccaattctcggtttaaatattgtggaatttgctggtaataataaagaaaaaataggccgccaagtcaccgcactttgtcacttacttgatgaaaaaatcgaacataaccaagatcacattattggctatcaagtttgttctgatttaccctctatcgaacgtatttatgcaatgcgaaaaaaagcagtgggcttacttggtaatgcaaaaggtgcagccaaaccgattcctttcgtggaagatacttgtgtccccccagaaaatcttgcggattacatcagtgaatttcgcgctttattagaccagcaccatttacaatatggcatgtttggtcacgtggatgctggtgtgttacacgttcgccctgcacttgatttatgcgataaagaacaagtgaaattatttaaacaaatttcagatgaagtggcagaacttacgattaaatatggtggattactctggggagaacatggaaaaggcgtgcgatcccattacggcgaaaaattctttaccccagaactctggtacgaacttcgttatatcaaaaccttgtttgatccgaacaatcgcttaaatcccggcaaaatctgtacacctttggattcccaagaggaactttattctattctttcgccaatgcgagctgataaggatcgccaaattcctatccaagtgcgtgatgaatttaagggtgcgatgaactgcaatggaaacggattatgtttcaattttgatgaacacagcattatgtgcccatcgatgaaagtcagtaaaaaccgtgtattttcgccgaaaggtcgcgcagcaatggttcgagaatggcttcgattgatggcgaatgaaaatgtttcgcccgcacaattagacttccgtaaaacagaaataaaactaaccgcacttgtgaaaagactaagcaatacggttaaaaaatggcgaggcgattatgatttttctcacgaagtaaaagtcgcaatggatacttgccttgcttgtaaagcctgtgcgagccaatgcccgattaaaatcgatgtaccaagtttccgtgcgaaattctttcatttctatcacagccgctacttacgccccgcaaaagatcacattgtggcaaatttagaaatcgctgcgccttatatggcaaaacaggcaaaattctttaattattttaccaagctaaaagtcacgcaaacattagtggaaaaaacgctaggcatgaccgatttgcccttgctttctgaacccaatttgcaacaacagctggtagaaattcattatcaaggcaaatccttggaagaattggaaggcctaagtgcggtagaaaaaaacgatattttatttattgtgcaagatccttatacctcttactatgatgcgaaagtggtacgagattttgttatgcttacgcagaaattaggcttcacaccaattctgttgccatttaaaccaaacggcaaagcaatgcacattaaaggtttcttaaaacgctttagcaaaacagcagaaaaccaagccgagtttttaaatcgaatggcaaaattaggcattcctcttgtgggcgttgatccagccatcgtgctgtcttatcgagatgaatacaaagaagcactacaagaaaaacgtggcgattttcacgttctcaccgcacacgaatggttaaaacaaagattacaaaatgcggatttacaagagaagttaaaaaacatcgccaaaactgaccgcactttcgattggtatttattccagcattgtacggaatctacctttatgccaaacagcccaaaagaatggcaagaaatttttggaagatttggacaacaacttaatgtagaaaaagtaggatgttgcggtatggctggtgtatttggacatgaagtgcaaaatcaaaaaatgagccgagaaatctacgatgtatcctggcacaaaaaactgcatgaaaaagatccgcacttttgtttagcaactggttattcttgccgcagtcaggtaaaacgttatgaacatgtggtgttaaaacaccctgtgcaggcattattagaaattttagcgtaa

SEQ ID NO: 652 - protein, 1027 aa, H. influenzae
MLPSLNRIPQIEQYVLDYLDDLQHQHFEGDIATNYSDRLSLATDNSVYQQLPQAILFPKTIADIVRITKLANLSEYQSISFTPRGGGTGTNGQSINNNIIVDLSRHMTAILELNVKERWVKVQAGVVKDQLNQFLKPHGLFFAPELSTSNRATLGGMINTDASGQGSLQYGKTSNHVLALRAVLMNGEILDTSAVNSVDVLENIDALELSESSKRLHQTIAQHCKEKRAAIIKDLPQLNRFLTGYDLKNVFNEDESEFNLTRILTGSEGSLAFICEAKLNLLPIPQYRTLINIKYRSFDAALRNAPFMVKANALSVETVDSKVLNLAKQDIIWHSVNELLTEDEKDPILGLNIVEFAGNNKEKIGRQVTALCHLLDEKIEHNQDHIIGYQVCSDLPSIERIYAMRKKAVGLLGNAKGAAKPIPFVEDTCVPPENLADYISEFRALLDQHHLQYGMFGHVDAGVLHVRPALDLCDKEQVKLFKQISDEVAELTIKYGGLLWGEHGKGVRSHYGEKFFTPELWYELRYIKTLFDPNNRLNPGKICTPLDSQEELYSILSPMRADKDRQIPIQVRDEFKGAMNCNGNGLCFNFDEHSIMCPSMKVSKNRVFSPKGRAAMVREWLRLMANENVSPAQLDFRKTEIKLTALVKRLSNTVKKWRGDYDFSHEVKVAMDTCLACKACASQCPIKIDVPSFRAKFFHFYHSRYLRPAKDHIVANLEIAAPYMAKQAKFFNYFTKLKVTQTLVEKTLGMTDLPLLSEPNLQQQLVEIHYQGKSLEELEGLSAVEKNDILFIVQDPYTSYYDAKVVRDFVMLTQKLGFTPILLPFKPNGKAMHIKGFLKRFSKTAENQAEFLNRMAKLGIPLVGVDPAIVLSYRDEYKEALQEKRGDFHVLTAHEWLKQRLQNADLQEKLKNIAKTDRTFDWYLFQHCTESTFMPNSPKEWQEIFGRFGQQLNVEKVGCCGMAGVFGHEVQNQKMSREIYDVSWHKKLHEKDPHFCLATGYSCRSQVKRYEHVVLKHPVQALLEILA

SEQ ID NO: 653 - DNA, 222 bp, H. influenzae
atggaacgcaaagaatataaggtgtttaaatcaggtttaaatttcttagaagggattgcaaattggataggaattcaaaatcctcaattaacgcaaacagaagatttattttctaacgaatcggataaaaatgactttggattgcaaaaacgaattgatgaaaaatatcgtaaagatgacgatccagccattgatattcgtcctaaacacggagcatattga

SEQ ID NO: 654 - protein, 73 aa, H. influenzae
MERKEYKVFKSGLNFLEGIANWIGIQNPQLTQTEDLFSNESDKNDFGLQKRIDEKYRKDDDPAIDIRPKHGAY

SEQ ID NO: 655 - DNA, 1032 bp, H. influenzae
atgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagacaagtacggaaaaataggtgcagataatgagcaatatgtgagttatgaacaaattgctaagtttattttgcagcacactgaaaatcatttagctcagcaacgagaaatttttcgtcgaattatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataa

SEQ ID NO: 656 - protein, 343 aa, H. influenzae
MNFCRILLKPLKKNEVHSGYSTKGLHYLTGNKHFNPELPFSRQEFITVKPQKQQGMSISGFQPKLQLIIKDDHFDSVDQQGHYILKPSPEEYPFLAENEHATMRIMKELGFDVPENGLVSFAGEQNQKEFAFVIKRFDRDEQQTEIHQEQLDGAMNIRDKYGKIGADNEQYVSYEQIAKFILQHTENHLAQQREIFRRIIYAYLLGNNDLHLRNFSFIYPKNSHPKLAPIYDFVSVSPYPEIFNSTLLALPLLAREEGNATLAKGFNTQYGEYIGDDFVEFGENIGLNKNVIIQKLIPEITQEKEKVEQIYSQSFMPQPHIDCVLKTYRKRLALLNVLNEPEL

SEQ ID NO: 657 - DNA, 798 bp, H. influenzae
atgtatttaatcgaaacctattttcgcctgactgcactcgaaaataatattgaatcacaaagtcgtttactcaatgcagtgatcgatcaatggcggtataacgggcaaattatcggacgtgaaattcctttatatttagcggaagaagatggtgcacaaggttttgctatgcgtgtcatttgccctgagcaagatagtcttttcccacaaaataataacgcagaagtgaatcgtgcattacaagaagcagaaaagtgcggtgtaatttttgatggttttcaacttgtgggcgatgatttcaattcagatcaaacagcagaaaatacatcgccagcttggcaagtgctttacacaacccatttacaaagttgctcgccgattcatagtggagaaaatttcgcaccaattccgttgtataaacagttgaaaaatcaaccgcacttaagccaagatctgattaaatggcaagaaaattggcaagcctgcgatcaactacaaatgaatggtgcggtattagaacaacaatctttggcagaaatttcggagcaccaaagcacactttcaaaacacggacgatatttagctcaagaaatagaaaaagaaactggcataccgacttactattatttatatcgtgtaggtgggcaatctttaaaatctgaaaaatcccgttgctgcccttcttgtggtgcaaattgggcgttaaaaaacgcgatttttgatacctttcattttaaatgcgatacctgtcgattcgtttcgaatctatcgtggaatttttttgtaattaatttataa

SEQ ID NO: 658 - protein, 265 aa, H. influenzae
MYLIETYFRLTALENNIESQSRLLNAVIDQWRYNGQIIGREIPLYLAEEDGAQGFAMRVICPEQDSLFPQNNNAEVNRALQEAEKCGVIFDGFQLVGDDFNSDQTAENTSPAWQVLYTTHLQSCSPIHSGENFAPIPLYKQLKNQPHLSQDLIKWQENWQACDQLQMNGAVLEQQSLAEISEHQSTLSKHGRYLAQEIEKETGIPTYYYLYRVGGQSLKSEKSRCCPSCGANWALKNAIFDTFHFKCDTCRFVSNLSWNFFVINL

SEQ ID NO: 659 - DNA, 891 bp, H. influenzae
tgaaccaaccaaccaaccaaccaaccaaccaaccaaccaaccaaccaaccaaccaaccaaccaaccaaccaaaataataaaaccgttgcggtagtaacttcaacaataggtcgtccagaattatctttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagtttggggttaataggtcaaacttcaggaaaatataccgttaaatacagagctgatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataa

SEQ ID NO: 660 - protein, 295 aa, H. influenzae
TNQPTNQPTNQPTNQPTNQPTNQNNKTVAVVTSTIGRPELSLAIKSVQNQTYPCKHYVFVDGNIFWDKAKSILEQFPDVIPIYLPMNTGKNGILNGAINAVAAFLVEEDIICYLDDDNQLREDHVESLVNVIEQGADFAYSLRSFYDSNHQFICNDDFDSLGNWNTKSDIFVDVKIEDIQKQIHFTFNEVNGHIDTNCYAVPREIAQKTSYSWNTPLIGDRSFLSALKSLGLIGQTSGKYTVKYRADFNKLIAVRRVFPQLSLSDEDNNNISAKILEVINQQNIEYYGGRPWAKE

SEQ ID NO: 661 - DNA, 1365 bp, H. influenzae
atgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgtgttatagagcaagctttaacaaacaataaagatttagctaaagctgctgtagcggtaaaccgtgcgctttatagtgcgaatttagtgggtgcaaatttagtgcctgcatttaatggttcaacttcatcagcagcacaacgccgagttgatatcagtacaaactctgccacttcacacaaaggttctttaaatgtgagctatacattagatctgtggcaacgtttggccaatactgttgatgcggcggaatggtcgcacaaagcaactgcagaagatatggaatcggctcgtttatcattaatcaattctgtagtaacaacttattatcaaattgcttatttaaatgatgctattagcacaaccaacgaaacgatcaaatattacacggatattggcaatattatgcaaacgcgtttagcgcaaggcgtggctgatgcagccagcgttgatcaagctcaacaagccatattaacggcgcgtaataacaaattaaattttgaaacccaacgcaaaacagcagaacaaacactgcgtaatcttctcaacctaaaaccaaatgaagcattaaatatcacgttcccacatattatgaatgtgaaaacggcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacagttggtacggcattacataaccctgtggctgctggcacagtaggaattagcttgccattcttaaattggaacaccgtaaaatggaacgttaaaatttctgaagctgactatgaaacagcacgtttaaattacgaacaacgtattaccacggctctcaataatgtggataccaactattttgcctttacccaagcgcaaagtacattaagtaatttacagcaaacccatagttacaatcagcgtatcacacaatattatcgaaatcgctataatgcgggcgtgtccgaattgcgcgaatggttagttgcagccaatacggaaaaatcatcacaacttgcgattttgaatgcaaaatatcaagtgctacaaagtgaaaatgcggtatatagctcaatggcgggatattatttgtaa

SEQ ID NO: 662 - protein, 454 aa, H. influenzae
MFKMKNITLALLMSGALVGCANIGDSYQASLEDYKQYEEITKQYNVKENWWSLYDDAQLNRVIEQALTNNKDLAKAAVAVNRALYSANLVGANLVPAFNGSTSSAAQRRVDISTNSATSHKGSLNVSYTLDLWQRLANTVDAAEWSHKATAEDMESARLSLINSVVTTYYQIAYLNDAISTTNETIKYYTDIGNIMQTRLAQGVADAASVDQAQQAILTARNNKLNFETQRKTAEQTLRNLLNLKPNEALNITFPHIMNVKTAGVNLNVPVSVIANRPDVKAAQFRLSSAFKNAKATQKSWFPEVNLGASLSSTASTVGTALHNPVAAGTVGISLPFLNWNTVKWNVKISEADYETARLNYEQRITTALNNVDTNYFAFTQAQSTLSNLQQTHSYNQRITQYYRNRYNAGVSELREWLVAANTEKSSQLAILNAKYQVLQSENAVYSSMAGYYL

SEQ ID NO: 663 - DNA, 2115 bp, H. influenzae
tgacaaaggaaaatttattatgaaactcgaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaa

SEQ ID NO: 664 - protein, 703 aa, H. influenzae
QRKIYYETRSKQASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 665 - DNA, 1398 bp, H. influenzae
tgaaacaaccaacaaccaacaaccaacaaccaacaaccaacaaccaacaaaaatatattgcccgaaattgttgtgtatggcgacaataataaatcactttcttccgttaaaacactctcttctgacgagataagtaaaacgcctacatcaaacggtaatatcactgattatcttcgttctaatccccatattcgttatgaaaatagcgaccaagatggttttcaacgtggagaaatcaagcctgaaaatatttcaattaacggtgccgatccaaatcaaactgcttattttgttgataatgtcaatataaataatgaacttactgctgatagcgatatttttgatggttctatgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatttaa

SEQ ID NO: 666 - protein, 464 aa, H. influenzae
NNQQPTTNNQQPTTNKNILPEIVVYGDNNKSLSSVKTLSSDEISKTPTSNGNITDYLRSNPHIRYENSDQDGFQRGEIKPENISINGADPNQTAYFVDNVNINNELTADSDIFDGSMQVVPGISHTQAYFFDATMLSKVEVQDSNISASLGGFMGGAVIAKTKQYSGTDSIKLKYRTTNSSWAKMEAGDSVQKILKQVRPDLVGVAELQPKYDKQTFNILAEKRLNDNLGMVFGYSRRTSSIEQNRLIGFDQNANNKAQLDKQNHQRLSDNLLLNFNWTPQEKERIELGLRYSNYKELKYFQENINNNVSDYHQALGTTLAWVHSFNSGVWTNTLAYDRFKDKRKSSSNSVETTSVLDEYYEALYNFEKGGHGNSRLTQDNLHFSTEYVMDPFYLASTEHSVSIGGIYQATKYQFYRPQDVHSKITLSTLQSDGSMNIFRSDKSTTPKVVLKPAIKISLFMLKI

SEQ ID NO: 667 - DNA, 1869 bp, H. influenzae
atgtcatctattaaatatcgtccagaaattgatggactacgcgcaattgctgttatttcagtcattatttatcatcttaatgaaaactggttatcaggcggttttcttggggtggatattttctttgttatttctggttttctgattacgggtattattatcacagaaattcaacagaattctttttcgcttaaacaattttatactcgacgtattaaacgaatttatcctgcttttattacagtgatggcattagtgtctttcattgcgtctgttatttttatttataatgatttcaataaattaagaaaaaccattgaattagctattgcattcctatctaatttctatctaggattaacacaaggttattttgatttaagtgcaaatgaaaaccctgtattacatatttggtcattagccgtagaagaacaatactatcttatttttccactaatcctcattttagcttataaaaagtttagagaaattaaagtattatttattataacgctaattttattttttattttacttgccacctcttttattccagctaatttttacaaagaagtattgcatcagcctaatatttattatctctccaacctaagatttcctgaattacttgtaggatctttgttggcaatttatcataatctttcagcaagcaagcaagcaagcaagcaagcaagcaatgttattgcaatattaagtacattactattattttcctgcttatttttaatgaataatgatattgcatatattccaggtattactttaattctcccttgtatttttacagcattaattattcataccacatcacaaaataacattattaaattatgtttatccaataaagtgatagtatttattggaaaaatctcttattccctttatttataccattggatttttattgcgtttgcttattatataacgggcgaaaaacaaattaataatcaatctatcgctatagtaataatattaacaataattttttcagttctaagttattatttaatcgaacaaccaattagaaaatcgaaactaaactttaaacaaagttttctttatatttattttattccttctcttttactcttaggatttaatctttataaaagacaaacaatacgagctgaaaaagaacacattgaacaatcaattcctgtttctaatgaaaatcattatcctgctaaggtcattattttaggcgattctcattcttcacatttagaagcttttctaaactatgtgggaaataaagaaggctggaaagcagatattttcaaagataaatttgaatgtagctttattgtgaatgaacaatatcaattagatcctaattgccaatctgtatggcagaaagattctcaatataaagcgatatttatttcagcattttatgacttgagaatgggcggacagccagtacctcgctttagacccgaaactttcatagagccagattttaaagcacgttttaaaaacacagtgaaacaactagcgatgcaaaagcccgtatatgtttttgctaataatagctcagtaagccgttctccactgcgtggttacttattagaaaattatggacttgaaaaatatttaacgccaattcatcgtatgggcgatattgatgcgagtaacaaaattattcatgatttagtcaaagatattcctaatgtttattgggtagatgctcaacagtatttaccaaaagatagtgttatggcagaaggaaaatacttgtatggggatcaagatcacttaacaaattttggtgcttactatatggcaaaagaatttagtaaatatcaacgagtgatgacacctgaacaagtgaaaaaactctacgagtaa

SEQ ID NO: 668 - protein, 622 aa, H. influenzae
MSSIKYRPEIDGLRAIAVISVIIYHLNENWLSGGFLGVDIFFVISGFLITGIIITEIQQNSFSLKQFYTRRIKRIYPAFITVMALVSFIASVIFIYNDFNKLRKTIELAIAFLSNFYLGLTQGYFDLSANENPVLHIWSLAVEEQYYLIFPLILILAYKKFREIKVLFIITLILFFILLATSFIPANFYKEVLHQPNIYYLSNLRFPELLVGSLLAIYHNLSASKQASKQASNVIAILSTLLLFSCLFLMNNDIAYIPGITLILPCIFTALIIHTTSQNNIIKLCLSNKVIVFIGKISYSLYLYHWIFIAFAYYITGEKQINNQSIAIVIILTIIFSVLSYYLIEQPIRKSKLNFKQSFLYIYFIPSLLLLGFNLYKRQTIRAEKEHIEQSIPVSNENHYPAKVIILGDSHSSHLEAFLNYVGNKEGWKADIFKDKFECSFIVNEQYQLDPNCQSVWQKDSQYKAIFISAFYDLRMGGQPVPRFRPETFIEPDFKARFKNTVKQLAMQKPVYVFANNSSVSRSPLRGYLLENYGLEKYLTPIHRMGDIDASNKIIHDLVKDIPNVYWVDAQQYLPKDSVMAEGKYLYGDQDHLTNFGAYYMAKEFSKYQRVMTPEQVKKLYE

SEQ ID NO: 669 - DNA, 4629 bp, H. influenzae
atgaacaagatatatcgtctcaaattcagcaaacgcctgaatgctttggttgctgtgtctgaattgacacggggttgtgaccattccacagaaaaaggcagtgaaaaacctgttcgtacaaaagtacgccacttagcgttaaagccactttccgctatattgctatctttgggcatggcatccattccgcaatctgttttagcgagcggtttacagggaatgagcgtcgtacacggtacagcaaccatgcaagtagacggcaataaaaccaccatccgcaatagtgtcaatgctatcattaattggaaacaatttaacattgaccaaaatgaaatggtgcagtttttacaagaaaacaacaactccgccgtattcaaccgtgttacatctgaccagatttcccaattaaaagggattttagattctaacggacaggtctttttaatcaacccaaatggtatcacaataggtaaagaagcaattattaacactaatggctttactgcttctacgctagacatttctaacgaaaacatcaaggcgcgtaatttcacccttgaacaaaccaaggataaagcactcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaataaccatcagcgacataataaacccaaccattacttacagcattgctgcccctgaaaatgaagcaatcaatctgggcgatatttttgccaaaggtggtaacatcaatgtccgcgccgccactattcgcaataaaggtaaactttctgccgattctgtaagcaaagataaaagcggcaacattattctttccgccaaagagggtgaagcagaaattagcggtgtgatttccgctcaaaatcagcaagccaaaggtggtaagttgatgattacaggcgataaagttacattaaaaacgggtgcagttatcgacctttcaggtaaagaagggggagagacctatcttggcggcgacgagcgcggcgaaggtaaaaacggcattcaattagcaaagaaaacctctttagaaaaaggctcaacaattaatgtatcaggtaaagaaaaaggcgggcgcgctattgtatggggcgatattgcgttaattgacggcaatattaatgctcaaggtagcgatatcgctaaaactggtggctttgtggagacgtcggggcattacttatccattgacagcaatgcaattgttaaaacaaaagagtggctactggaccctgataatgtaacaattgaagctcctagcctttctcgcgctgacactgacattagttcagaatttccaatcggtgacggtactgaaaacagccctaaaaaaaacgccgacaaaacaatactgaccaatgaaaccatttcaaattttctgcaaaatgccaaagtgatgaacataacggcaaagagaaaacttaccgttaatagctcaatcagtatcggaagtagatcccacttaattctccatagtgaaggtcagggggacggaggcgttcagattgatggagatattacttctgaaggcggaaatttaaccattaactccggcggatgggttgacgttcataaaaatattacgcttggtacgggttttttaaatattaccgctgggggttctgtagcttttgagaaagggggcaataacgcacgtaacgcaacagatgctcaaattaccgcacaagggacgataaccgtcaataaagatgataaacaatttagattcaataatgtatctattaacgggacgggcgagggtttaaagtttattgcaaatcaaaataatttcactcataaatttgatggcgaaattaacatatctggaatagtaacaattaaccaaaccacgaaaaaagatgctaaatactggcatgcatcaaaagactcttactggaatgtttcttctcttactttgaatgacgatgcaaaatttacctttataaaattcgttgatagcggctcaaattcccaagatttgaggtcagcacgtagacgttttgcaggcgtacattttaacggcaccggaggcaaaacaaacttcaacatcggagctaacgcaaaagccttatttaaattaaaaccaaacgccgctacagacccaaaaaaagaattacctattacttttaacgccaacattacagctaccggtagcagtgatagctctgtgatgtttgacatacacgccaatcttacctctagagctgccagcataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaaggcaatctcacaatttcttctgacaaagtaaatatcaccaagcagataacaattaaagcaggcgttgatgagaaggattctagttcaagcacagcaagtgatgccaatctaaccattaaaaccaaagagttaaaattggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggtaacgtagaagtgacagccaaaacaggtgatattaaaggtgaagtcaaatccacttccggtaatgtaaatattacagcaaacggcgacacgcttaatgtaagtaatgtttcaggcaatgctgttaccatcactgcagataagggcaaattaaccacccaagaaagctctacgattagcggaactgagagtgtaaccacctcaagccaatcaggcgatattggcggtgcaatttctggtaacacggtaagcgttaaagcaaccaatgatttaattaccaaagcaaattcaaaaattgaagcaaaaacaggcgaggctaatgtaacaagtgcaacaggtataattggcggcacaatctctggcaatacagtaaatgttacagcaaatactggtagtttaactattaaaggcggtgcaaaagttgatgcgacaaatggagctgcaaccttaactgcagaatcaggcaaattaaccactcaagcaggctctactattacctcaaacaatggccagacaactcttacagccaaggatggcagtatcgcaggaagtattgatgccgctaatgtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 670 - protein, 1542 aa, H. influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQENNNSAVFNRVTSDQISQLKGILDSNGQVFLINPNGITIGKEAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAATIRNKGKLSADSVSKDKSGNIILSAKEGEAEISGVISAQNQQAKGGKLMITGDKVTLKTGAVIDLSGKEGGETYLGGDERGEGKNGIQLAKKTSLEKGSTINVSGKEKGGRAIVWGDIALIDGNINAQGSDIAKTGGFVETSGHYLSIDSNAIVKTKEWLLDPDNVTIEAPSLSRADTDISSEFPIGDGTENSPKKNADKTILTNETISNFLQNAKVMNITAKRKLTVNSSISIGSRSHLILHSEGQGDGGVQIDGDITSEGGNLTINSGGWVDVHKNITLGTGFLNITAGGSVAFEKGGNNARNATDAQITAQGTITVNKDDKQFRFNNVSINGTGEGLKFIANQNNFTHKFDGEINISGIVTINQTTKKDAKYWHASKDSYWNVSSLTLNDDAKFTFIKFVDSGSNSQDLRSARRRFAGVHFNGTGGKTNFNIGANAKALFKLKPNAATDPKKELPITFNANITATGSSDSSVMFDIHANLTSRAASINMDSINITGGLDFSITSHNRNSNAFEIKKDLTINATNSKFSLKQTKDLFENQYTGDAINSTRNLTILGGNVTLGGENSSSNITGNITIAAEANVTLQAYADNSIKGHKKKTLTLGNVSTSGNLSLTGSKVEVKGDLAVLNGATFKGETNDSLNITGTFTNNGTADINIKRGVVNIQGDITNKGGLNITTNAQKNQKTIINGNITNKKGNLNITNNGNDTEIQIGGNISQKEGNLTISSDKVNITKQITIKAGVDEKDSSSSTASDANLTIKTKELKLVEDLNISGFNKAEITAKDGSDLTIGNTNSADGTNAKKVTFNQVKDSKISANDHNVTLNSKVETSGNTDNTGDGSGNNAGLTIAAKNVEVKNNITSNKTVNITASEKLTTKADATINATTGNVEVTAKTGDIKGEVKSTSGNVNITANGDTLNVSNVSGNAVTITADKGKLTTQESSTISGTESVTTSSQSGDIGGAISGNTVSVKATNDLITKANSKIEAKTGEANVTSATGIIGGTISGNTVNVTANTGSLTIKGGAKVDATNGAATLTAESGKLTTQAGSTITSNNGQTTLTAKDGSIAGSIDAANVTLNTTGTLTTVVGSSINANEGTLVINAQDATLNGDASGDRTEVNAVNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 671 - DNA, 4479 bp, H. influenzae
atgaacaagatatatcgtctcaaattcagcaaacgcctgaatgctttggttgctgtgtctgaattgacacggggttgtgaccattccacagaaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 672 - protein, 1492 aa, H. influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQESSNSAVFNRVTSDQISQLKGILDSNGQVFLINPNGITIGKDAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAANIRNQGKLSADSVSKDKSGNIVLSAKEGEAEIGGVISAQNQQAKGGKLMITGDKVTLKTGAVIDLSGKEGGETYLGGDERGEGKNGIQLAKKTSLEKGSTINVSGKEKGGRAIVWGDIALIDGNINAQGKDIAKTGGFVETSGHYLSIGNDAAVEAKEWLLDPDNVTISNGNDDQSQLKDDRGDSPNKILADNKHTVNNKTLSTALAKGIGVNISAKKKVNVTADINVHNGTLTLHSEQGGVEINGDITSEQNGNLTIKAGSWVDVHKNITIGMGFLNITAGGSVAFEKAGGDKGRAASDAKIVAQGVITAGSGQDFRFNNVSLNGTGRGLKFITAKGNKGNFSAKFDGVLNISGNISINHTANNQLSYFHRQGYTYWNLTQLNVDSDSSFSLTSIKDAIKVGGYDNAKDKKNTGGIGFTRDTIFNVKQGARVDISYTLPISPVKNSRIAAVNFDGNITVKGGGVVNLKFNALSNNYKTPGVNISSRFINVTEGSQLNITGSMPSTTLFNVANDLIINATNSFVSIKEIEGTDTHLDTGLKVNGNVTIKGGNVTLGSNKAKTKFDKNVTVEKGANLTLASANFGNHKGALTVAGNINTQGKLVATGDTIDVSGDFTVGNDATFNGNTNNNLNITGNFTNNGTSIIDVKKGAAKLGNITNEGSLNITTHANTNQKTIITGNITNKKGDLNIRDNKNNAEIQIGGNISQKEGNLTISSDKVNITKQITIKAGVNGENSDSGTENNANLTIKTKTLELTNNLNISGFHKAEITAKDNSDLIIGKASSDSGNAGAQKVIFDKVKDSKISAGNHNVTLNSEVETSNGNSNAAGDSNGNNAGLTISAKDVAVNNNITSHKTINISATTGNVTTKEGTTINATTGGVEVTAKTGDIKGGIESKSGGVTLTATGDTLAVGNISGNTVSVTANSGTLTTKADSTIKGTGSVTTLSQSGDIGGTISGKTVSVTATTDSLTVKGGAKINATEGTATLTASSGKLTTEASSSITSAKGQVDLSARDGNIGGSINAANVTLNTTGTLTTVKGSSINANSGTLVINAEDAKLDGTASGDRTVVNATNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 673 - DNA, 858 bp, H. influenzae
atgaaaacatctatttatcaattaaagtggggaacctttaatcttattgaaggggattttattagccaatatgctgcactttatggcgaatggtcagatgtagaagtccaattttttttggaaaacctaaattcttcaagtaatgtcattgaagttggttcgaatattggaatgcacgcagttcctattgcaaagacaataagtggggggggggggaaattattttgttttgaacctcaaagagtaatttttcagacactttgtgcgaatttgtcgcttaatcaattaacaaatgttcatgcctataatttgggggttggtgaaaatgaacagttgattgagattccctcatcaaattatgatactgcttggaattatggaagtttttcattagataaagggtttagtaccgagggtaattttataggtgtagaatctaaggaattgatacatgttatttctttagataaacacccagaagttaatcgattggaagatatagatctattaaaaattgatgctgaaggatttgagctaaatgttttaaatggtgcaaagaatctcatagagagacataagcctataatttttgtagaagctcatattcatcactctaatgagttgatatcctatttagataagattggttataagtgttattggtttatttctgaacgttatcaaaaaaataactactttaagcaggagaaatctcttggtggaatggactttaatttagcttgtttccataagagtaaacaatcaacattaccagaggaactacggacaacaccaaataatttattaactgaaataccaatagtaagtaacagatttgatctgcccccaaaaagttag

SEQ ID NO: 674 - protein, 285 aa, H. influenzae
MKTSIYQLKWGTFNLIEGDFISQYAALYGEWSDVEVQFFLENLNSSSNVIEVGSNIGMHAVPIAKTISGGGGKLFCFEPQRVIFQTLCANLSLNQLTNVHAYNLGVGENEQLIEIPSSNYDTAWNYGSFSLDKGFSTEGNFIGVESKELIHVISLDKHPEVNRLEDIDLLKIDAEGFELNVLNGAKNLIERHKPIIFVEAHIHHSNELISYLDKIGYKCYWFISERYQKNNYFKQEKSLGGMDFNLACFHKSKQSTLPEELRTTPNNLLTEIPIVSNRFDLPPKS

SEQ ID NO: 675 - DNA, 916 bp, H. influenzae
  misc_feature (818)..(818): n is a, c, g, or t
  misc_feature (849)..(849): n is a, c, g, or t
ctgttttcggatatcaatctcggttctcctgtatattagcaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcaccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaatttttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaccctgggnggttgttctttcacatcaatagttactttgntcgtatggctccttgttttttaccatccatatcacgatagattactttagggcgagaaacggcaagc

SEQ ID NO: 676 - DNA, 3964 bp, H. influenzae
  misc_feature (201)..(238): n is a, c, g, or t
gttctgggagatgacaagtgcggtcaattttcttaaaaattgtccgacagtatggtctaacttttgagagaacatattctctctcctattaaaatactctgcacttactctcattgtactcttattattcttttattaaaacctcgttttaagcaggaaaaatgtgatttttgcgatccacgtcgcaaattttactaattnnnnnnnnnnnnnnnnnnnnnnnnnnnnnnnnnnnnnncaacgttttctgcctctgacgcctcttttaatggtctcagatgtcctttggtcaccagttctgccagcgtgaaggaataatggccgagcatattgatatgtccgtggcaaagcggggagaggcgtgcgatatcttcatcattcagtgtttcaccctgcgcccggagatgatccagggctgcctgcatataaatagtgttccataacacgacggcgttagtgaccagccccagtgtgcccagttgatcttcctgaccgtcggtatatcgttttcttatctcacctttttgaccgtgacagatggctctggcaacggcatggcgactttctccccgattaagctgggtcagaatgcgccggcggtaatcttcatcatcaatataattaagcagatacagcgttttgttgatgcgccccacttcaatgattgcctgagtcagtccggaaggacgttcacttttcagcaatgaacggaccagcactgaaacctgtactttgcccagcttcagggagccagcggtccggatcatttcgtcccactgaaggactatttttcggggatctgattgccctctggcaatatcattcagcacgccatagtcggcatcatggtccattcgccagaaaaccgaagcaccggcatcagccaggcgtggagaaaactggtatcccagcagccagaaaaggccaaagacaagttcgctggcacctgctgtatcggtcataatttcggttggattcagcccggtctcctgttccagaagaccttccagcacaaagatagagtccctcagcgtccccggtataacgatgccatgaaagccggaatactgatcggacacaaagttgtaccaggtgatccctctgttattaccaaagtatttgcggttcggtccggcattgattgttctgactggcgtaacaaagcgcattccatctgcagatgccacttctcctccaccccatatctgtgccagtggcagcgttgcctgaaaatcaaccagtctggcattagcgctggtgatagtttcagcccgcagatagttcgcttttgtccagttcagccggtgtcgggtcagtgcaggaacatttgatctgatcagtggttccagaccgatattgcaggcttcagccatcagcacggcgctgatgctgacgggcagatcatcaactctggcactggcttcactagcatggaaaaactcatcagcaaatccggtatgggcgttaatttcgagcagcaactccgttaaatccaccggagggagtagatcactgatcattttgctcagtcgtttcagactgtccggctcatcaagactggcgaggggagaaattgtcaaccggggcttcgggccagaaacatcgagttcgacagcctcattttcgcaaagacgtgcagcaacctgtctgtaacgactatcaagctgatgacccagagattttattgcttcctgcgggtctgtcgggtgccccaaagaacgataaaccttaatccggtttgcctgccagtcagcaccctgtagtaatcttgcacgaggatctccccaccggttactgccggtaacgtagacatccctccgcctcagactatcctgcagtttactgagaaagcagagcgtgtatcccctgcgggtgatatgtttttccttgttaatcaccagccgtttccatgaccgactgataatttccgttggtgcgtcgtcaaaaaactgccgccgtgagctgaactcccggctgaggtagtcacaggcattcagagtggtaaccccggcaggtgcggatgaaaatttaacggtattcagcagatggggcaggaaacgacgaacgcgcccgtactgctccaccatttcttcatgaaaattatcgtctgagggccgggcaatttcacggacaagcgtgatgatttcagccagcttttgccttgggatgtagctgaacacctcagcacgaatcgattcgtccggtgtttcttctttcagcaggtacgaacatgcgctggcgagcgccaatgcagatttatccagatccttcagcgagcggagccgttttttctgcccaatctttctggcgtcacggatgataacggccagcatggcgtccagaacgtccaatgcatcatccagcgccagcgtttcccatgcaaggacaaaggcaaccagaaccgccatccttttctgcggtgacatcctggcaatattgaacaccgaagtcataccagcataacgtgcgagatttttcaggcgcacagccgggagtgtactcaggttttcagcatgcaggccaaaatcgttcagagttttccagcgttcaattgcttcattaaacgccggaccactgatggtcacagggccctttttcagtgattccagtaaagacaggcggctgcaatcagttggccccagcagcatctccagctgtgaacgctgttcggctgacggtatcagtgccagtttgttccacaggcgcaacgtcgccttttcccttacctctgaaatcaaccgggtcagcgtagtggctccggggagaataatacgatgttgcataagccaccctgtcgccagatcgaaaagcaggccaggacgttcgttgcttatccagctccgggtatataaaagacgggtaaggcgaaatgtccagggccaggcaaattcacgatactgatagtgctgacgtatcagcgctgcatgctcacggcgggtattttccctctgaccgtattctgcaagaacggtgatatcacgaatcccgagctgtctggcggtaaaatgccggacgccggaaggaatatgattcatatcggtgaggaaggtgcccagaaaacggacacatccaatttgcagggcaatgcccagacggttgtgatcacctctgctttttccgataaattccttgtctgcttcatcaaggtgaaaatatcgtgccagctgaagctcatccggttcaccggtgaatctgccatagctttcagtctgctcagtggtcagaaagtcaacgggcatatcggcctccctgcctgacgggcatttagtaacatttttccaaccgtacgaaatgttataaattatcggacatcgtaaaactgttacattaatatgtctattaaatcgtaaatttgtaataatagacatgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaatcttgaaggggtaccgagttgaatctatca

SEQ ID NO: 677 - DNA, 15147 bp, H. influenzae
  misc_feature (14517)..(14517): n is a, c, g, or t
  misc_feature (14576)..(14576): n is a, c, g, or t
  misc_feature (14583)..(14584): n is a, c, g, or t
  misc_feature (14594)..(14596): n is a, c, g, or t
  misc_feature (14624)..(14624): n is a, c, g, or t
  misc_feature (14642)..(14642): n is a, c, g, or t
  misc_feature (14646)..(14646): n is a, c, g, or t
  misc_feature (14665)..(14665): n is a, c, g, or t
  misc_feature (14681)..(14681): n is a, c, g, or t
  misc_feature (14708)..(14708): n is a, c, g, or t
  misc_feature (14723)..(14723): n is a, c, g, or t
  misc_feature (14725)..(14725): n is a, c, g, or t
  misc_feature (14751)..(14751): n is a, c, g, or t
  misc_feature (14763)..(14763): n is a, c, g, or t
  misc_feature (14766)..(14770): n is a, c, g, or t
  misc_feature (14772)..(14772): n is a, c, g, or t
  misc_feature (14793)..(14793): n is a, c, g, or t
  misc_feature (14796)..(14797): n is a, c, g, or t
  misc_feature (14799)..(14799): n is a, c, g, or t
  misc_feature (14824)..(14826): n is a, c, g, or t
  misc_feature (14828)..(14829): n is a, c, g, or t
  misc_feature (14832)..(14832): n is a, c, g, or t
  misc_feature (14835)..(14835): n is a, c, g, or t
  misc_feature (14838)..(14838): n is a, c, g, or t
  misc_feature (14840)..(14841): n is a, c, g, or t
  misc_feature (14846)..(14848): n is a, c, g, or t
  misc_feature (14861)..(14862): n is a, c, g, or t
  misc_feature (14864)..(14864): n is a, c, g, or t
  misc_feature (14866)..(14866): n is a, c, g, or t
  misc_feature (14868)..(14868): n is a, c, g, or t
  misc_feature (14870)..(14871): n is a, c, g, or t
  misc_feature (14877)..(14878): n is a, c, g, or t
  misc_feature (14880)..(14880): n is a, c, g, or t
  misc_feature (14886)..(14886): n is a, c, g, or t
  misc_feature (14918)..(14920): n is a, c, g, or t
  misc_feature (14922)..(14924): n is a, c, g, or t
  misc_feature (14929)..(14930): n is a, c, g, or t
  misc_feature (14932)..(14932): n is a, c, g, or t
  misc_feature (14934)..(14934): n is a, c, g, or t
  misc_feature (14938)..(14938): n is a, c, g, or t
  misc_feature (14942)..(14942): n is a, c, g, or t
  misc_feature (14947)..(14947): n is a, c, g, or t
  misc_feature (14952)..(14953): n is a, c, g, or t
  misc_feature (14964)..(14966): n is a, c, g, or t
  misc_feature (14972)..(14972): n is a, c, g, or t
  misc_feature (14974)..(14977): n is a, c, g, or t
  misc_feature (14980)..(14980): n is a, c, g, or t
  misc_feature (14983)..(14984): n is a, c, g, or t
  misc_feature (14997)..(14998): n is a, c, g, or t
  misc_feature (15008)..(15008): n is a, c, g, or t
  misc_feature (15028)..(15028): n is a, c, g, or t
  misc_feature (15030)..(15030): n is a, c, g, or t
  misc_feature (15034)..(15037): n is a, c, g, or t
  misc_feature (15049)..(15049): n is a, c, g, or t
  misc_feature (15058)..(15058): n is a, c, g, or t
  misc_feature (15062)..(15062): n is a, c, g, or t
  misc_feature (15072)..(15072): n is a, c, g, or t
  misc_feature (15096)..(15096): n is a, c, g, or t
  misc_feature (15112)..(15113): n is a, c, g, or t
  misc_feature (15116)..(15119): n is a, c, g, or t
  misc_feature (15123)..(15124): n is a, c, g, or t
  misc_feature (15127)..(15128): n is a, c, g, or t
  misc_feature (15130)..(15133): n is a, c, g, or t
  misc_feature (15140)..(15140): n is a, c, g, or t
tagacttaatgctaatttagccgcttacgttgccattaaatcaataggatagcgaattgtggttagttttgggatcaaataacgggcaatcggcatatcatcaaaaccaataattgaaaattggcttggtacgctgatattgttttcattgagaactgaaatggctcccgccgccattgaatcgttataagcaacgacagccgtaagatttttgttataactaagtaaatcaatcattgctttttcgccgccttcaaagtctggactattgagtgttatcgcctgttcaatgatgggataattgtgatcttttaatgcggcaagataaccatttcttctttcaacttcatcaaaaatggcgtgatttgaaccgatatatgcaatatgttgatgcccataacgaataagcatttccgtggctaaataagtgcctttttggttatctaaactgacacaacgatgttcataacctttaataacacggttaatgattaccattccttgcacagtatttaaataatggcttaattcatcatcagataaggctttagaatgtacaacaagagaactacaacgcttacgtaataaggtattaattgcttcccgctctttttccgcatgatgataaccaataccgataagaatcgttttttgatgcgcttctgctactttatccaccgctttcactaaaatcgcaaaaaaagcatccgtcacatcggttaccaccacgccaattgtatcggtgttctgcacggcaagggcttgagcatttgcattaggttgataagctaactgtgcaatagcttgttccaccgcaaggcgtgtattttcactaacagaaagagagtgatttaatactcgggatacggtagcgacagatacattggctaatttagcgacatctcgaatagtactcataactttttccttgttataatctataaatcttatattttgatcataaataatttacgataaattgaaaacggttactttcataagtatgaactaaatcataaaaaattttgcttattttcttattttgtgacaaagatcacggtttatttacaataatttagtataaattaatgtaatcgcttacattgataaaaaacaggagtcaaaatgaccgcactttttgaacctacagaacatccacatcgtcgctacaatccgttaatcgatcaatgggttttagtttcgccacatcgtgccaaacgcccgtggcaagggcaacaggaaaaagtcaatgaagaacaaaaaccaagttatgatccaacttgttatctttgtccgagtaataagcgtattacaggggaattaaatccagattatcgtaaaccttatgtatttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactaaataatatagtcagttcccctctttagctttagcaaagagtggtgcagatcgagtatagatttaatataaaggatagaaatatgaccccaatccaaaatgctcaacaaattttcaatagacagcataaaaatttgccagaaattaccgtctatgcccctggtcgagtaaatattatcggcgaacatactgactacaacgacggctttgttatgccttgcgcaattaattttggtacggccgtttctggtacaaaacgagatgatcatatttggaatgtttatgctgcagatcttgatgaaactgatgaattttctctcaatgttgaaattcctaagagtgaacacaaatgggctaattatgtgcgtggggtggtaaaatttatccaagaacgttacccgcactttcaacaaggtgcaaatttagtgatttctggtaatgtgccgctttcttctggattaagttcttctgcagcgttagaagttgcggtgggtaaattctgccaacaacttggcgatttaccgctttctcacacggatattgcattgaatgggcaaaaggctgaaaaccaatttgtcggtgctaattgtggcaatatggatcagttaatttctgcgcttgggcaggaaaatcacttactgatgatcgattgtcgtagtcttgaaactattccaacaccagtgccacaagatgtcgccgtgattattgtgaattcaaacgtaccgcacgatttagtaacaggcgaatacaatactcgccgtcagcaatgtgaagaggcagtaaaattttttggcgcgaaagcattacgagatgtttcagttgagcaattccaaaaaagagaagcagaattgaccgcactttctccgttagcagcaaaacgtgctcgtcatgtcgtaacagaaaatcaacgagtacttgatgcggtagaagcattgaagaacaatgatttgacttgtttaggtaaactaatggaagcatctcacgattcaatgcgtgatgattttgaaatcaccgtgccacaaattgattatttagttgaattggctcaacttgttattggcaaaagtggcggtgcacgtatgacgggcggcggttttggtggctgtattgtcgcacttacgccgcatgataaagtcgatgcagttcgtaaaattattgcggataattacgagaaaacgactggtttaaaagaaactttttatgtgtgtaccgcatcacaaggtgtgcgagtgatttaagagaaaatgatgttagaacaaaccacttttaatgcgcctgatggtgcaccttatcagcttataaccctacaaaatgaaaatgggatgcgtgttcaatttctggattggggcgcaacttggctttcttgtaaagtgccagtaaatgacacattacgcgaggttttattgggttgtaaggtagagaattatcccactcatcaaagctatttaggcgcaagcgtagggcgttatgcaaatcgtattgcaaatgcacaatttgaattgaatggcgaacttattaaattaagtagtaatcaaggaaagcaccagcttcatggtggagagggttttgataaacgtcgttggaaaattcaagagtgcggtgagaattttgtgtgtttttcattacagtcagagcatggtgatcaaggttttcctggtaatgtggatgtgtctgtaacctatacgctaacagatgataatagcgtaaaaattgaatatgcagggatttgtgataaggatactgcattgaacctaacgaatcatgcttatttcaatttagaaaatgcagcgcaaggcagtgacgtgcgtgaacatacattacgtttaaatgctgatttttatctgcctgtagataatgaggggattcctaattctccattaaagcacgtggtgaatacaagttttgacttccgtattgctaaacccatcaagcaagattttttacaaggggatcagcaagcaacaaaaggttacgatcattcctttattgtcaataaagcttggcaaaagccttgtgtgttactaacctctccaactggcgatttaagtttggaagtaagaacctcgcaagctgcattgcaggtttatacgggtaattatcttgcaggtacaccaacgagaaatggcgaattatatgccgatttttctggcatagcactagaaacccaatgtttaccagatacgcctaatcatcctgaatggcaaaattacggcggaattcaaaaagcaagcgagcaatattatcaatggacagagtttaaatttaaataaaccattatttataataaaaatgtcattacaagatctataaattaggttcatttctagcgttaaaagcagtgacacaccaccagcctcttaatctaatttaattggtcaagcgatggcttttttatttacaaaggtttacactaacttcacatttactcaggaaatctattatgctcatttctcattctgaccttaaccaacaacttaaatctgctggaatcggctttaatgcaacagaactacacggctttttaagcggtttactttgtggtggattaaaagatcaaagttggctaccgctcttatatcaattcagcaatgataatcacgcttacccaacagcattagttcaacccgttacagaactttatgaaaaaattagtcaaaccttatcagatgttgaaggatttacctttggacttggtttaaccgaagatgaaaatgtctttgcacaagcggatagcctatctgactgggcaaaccaattcttacttggtcttggcttagcacaacctgaattagcaaaagaaaaaggtgaaattggcgaagcggtagatgatttacaagatatttgccaacttggttataatgaagatgataatgaagaagagcttgcggaagcactagaagaaatcattgaatatgttcgcaccattgcaatgttattctattctcatttcaacgaaggagaaattgagagcaaacctgtattacattaaggagatctaggatggaattgacttatatggctaaattgcctaaagaagaatttgaggaacgtcgcacacgagtattcgctcaaatgcaacctaattcagcattattgcttttttctgaaatcgaaaaacgccgtaataatgattgtacctatcctttccgtcaagatagctatttttggtatttaacaggctttaatgaaccgaatgcagcactgttattactgaaaacagaacaagtagaaaaagccattatttttcttcgtccatgcgatccgttacttgaaacgtggaatggtcgccgattaggtgttgagcgtgcaccacagcaacttaatgtaaatgaagcctattctattgaagaattcgctaccgtactgccaaaaatactgaaaaatttgaccgcactttaccatgtgccagaaattcatacttggggtgatacattggtgtcagaaagtgcggtgaattttagcgagattttagattggcgaccaatgctcagcgaaatgcgccttataaaatcgccgaatgaaatccgcttaatacaacaagcgggacaaattacggcacttgggcatattaaagcgatgcaaacaacacgcccaaatcgctttgaatatgaaattgaaagcgatattttgcatgaatttaatcgccattgcgcaagatttccttcttacaattccattgttgcaggaggaagtaacgcctgtattttgcactacacagaaaatgatcgcccattaaatgatggggatttagtactgattgacgctggctgtgaatttgccatgtatgcaggcgatatcacccgcacttttcctgtaaatggaaaatttagcccgcctcaacgtgaaatttatgagttagttttaaaagcccaaaaacgtgcgattgaattacttgtaccgggcaattccattaagcaagccaatgatgaagttattcgtattaaaacccaaggattagtggatttaggcatcttaaaaggagatgtggatacacttattgaacaacaagcttatcgccaattttatatgcatggattagggcactggctagggttagatgtgcatgatgtgggtagttatggccaagataaacaacggatactcgaaatcggtatggtaattaccgttgagcctggtatttatatttcagaagatgcagatgtgccagagcaatacaaaggcattggcgtgcgcattgaggataatttactcatgactgaatatggtaataaaatcctaaccgctgctgtccctaaagaaattgcagacattgaaaatttaatgaatttttaataaaaatgtttaaattgtgatctagtacacagttttttattgctcaaaatgttagcattggagccagttaaaaaccgaaccaatcagttaaggagtcgattatgtacaaacacgttttagtagcagtagatctttctgaagaaagtccaattttacttaaaaaagcagttgggattgctaaacgccacgacgcaaaactttctatcatccacgttgatgtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaataattaacaagaaattgttttttgaataatctgaaataacttaaattttaaccgcacttctcaaatagcgtcgtgaagtgcggttttattttggggttttggcaaaaagcctttttataaatttcaaaaatatgcaaaaatagggcgatttagtttttattttattatgggtaacaaggattctttttaatgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttggggcggacctccaggctcaccagaagaagatggcgaccgttatattgaaatctggaacgttgtgtttatgcagttcaaccgtttagcagatggcacaatggaaaaattacctcgtccgtctgttgatacaggtatgggtttagagcgtatttctgctgtgttgcaacatgtgaactcaaactacgagattgatattttcaaaacattaatcgcaaaaacggcggaaattgtaggcgcaacagatttaactaacaaatcactacgtgttattgctgaccatattcgttcttgtgcatatttaatcgccgatggcgttatcccatcaaatgaagggcgtggttatgtcttacgtcgtattattcgccgcgcagttcgtcacggtcatctattaggtgccaaagaatcctttttctataaactcgtgccaactctaattgaagtaatggctgaagctggaaaagatgtaaaagcaaaacaaacaaatgttgaaaaactattacgtctagaagaagaacaatttgctcgtactctagagcgtggcttgagcttattagatgaagcactttctcaagtgaaagatggcattctttcaggtgaagttgcattcaaactttatgatacttatggtttcccattggatttaacggctgatgtatgccgtgagcgtaacattactattgatgaacaagcgtttgaccgtgaaatggaagcacaacgtactcgtgctcaagcagcgagccagtttggtgtggactacaacagcgttattcgtgtagatggcgaaactaagtttgaaggctatactgaagtagaatctcaggcaaaaattaccgcacttttctatgatggtaaatcagtggaaagtatcgaagtaggtcaaagtgcggtcgttattttagaaaatacgccattttatgcagaatcaggtggtcagattggcgatagcggatatttaagcacacaaggtgtaacctttaatgtgaaagatacccaaaaatatgggcaagtatttggacacattggggaattaacgcaaggaagtttaaaagttggacaatcagtgaatgcgattgtggacgctaaacgtcgccacaacacatcactcaatcactcagcgacacacttattgcacgctgccttacgtcaaattctaggtttacacgttgtgcaaaaaggttcgcttgtttcagataaagccttacgttttgactttgcgcaaccagaagccattaccaaagagcaattgagtgaaattgaaacattagtaaaccaaaaaatccgcgctaactttccagttcaaacggatattatggatattgattccgcaaaagcgaaaggagcaatggctctctttggcgaaaaatatggcgataaggttcgtgtattaacgatgggcgatttctcaattgagctgtgtggcggtattcacgcaaaacgcacaggcgatattggtttatttaaaattattactgaaaacgcagtggctgcaggcattcgtcgtattgaagctgtaacaggtcaaaatgccattgactggttacataatcaacaacgcattctgacccaaagcgcagacttattaaaatcagacgtaaataccttagtggaaaaaatccaacaacttcaagacaaaacgaagaaagtggaaaaagaattacaaggtctaaaagaaaaagccgcaatgcaggctggttctgattttgtaaaaagtgcggtcaaaatcaacggtgtttctgttattgcacaacaattagatggtatagaaacaaaatcattacgcgtaatggtcgatgatttaaaaaatcaactcggatcaggcgtaattgcatttgcatcaatattagatgaaaaagttaatctcgtcgttggagtgacaaatgatttaaccgccaaaataaaagctggagaacttgttaatttaatggctcaacaagttggaggaaaaggcggtggccgtccagatatggcaatggcaggaggttcccaaccagaaaatgtggcacaagcaattaaagtggcacaagactggttaaacaaaaatctgtagtacaagctggttggtggaatgccaaccgttccttgattgataggatatctaataaatgcaaactaaggagataaaagatgttaatcttaactcgtaaagttggcgaaagtgtacttattggagatgatatttctatcacggttttgagtgtacgtggaaaccaagttaaactcggtgttgaagcacctaaagaagtatccgttcaccgagaagaaatttaccaacgaattaaacaaacgaaagatgaaccctatttaggttcctcttagttaaacaatggatataataatatgaaagcaattattcctgtcgccggtcttggcacacgtatgttgcccgccacgaaggcgattccgaaggaaatgctcactttggtggataaaccgttaattcaatacgtggtaaatgaatgtgtagctgctggcataaaagaaattgtgctggtaacacattcatcaaaaaatgctatcgaaaaccattttgatacatcttttgaattagaaacaatgctggaaaaacgtgtgaagcgtcagcttctagaagaagttcgttctatctgtccaaaaaatgtaaccattatgcacgttcgtcaaggtaatgcgaaaggtttaggtcacgccgtgttatgcggtcgtcctttagtaggaaatgaatcttttgccgttatgttaccagatgtattattagctgaatttagtgcagatcagaaaaaagaaaatcttgctgcaatgattcaacgctttaatgaaactggcgcaagccaaattatggtaaccccagttccgcaagaaaatgtgagtagctatggtgttgcagattgtggtggcattgagcttaatggcggcgaaagtgcaaaaattaatagtattgttgaaaaaccttctattgaagacgcaccatcaaatcttgctgtggttgggcgttatgttttttcagcagcaatttgggatttgttagaaaaaacaccaattggtgttggcgatgaaatccaattaaccgatgctattgatatgctcattgaaaaagaaaccgttgaagcatttcatatgacaggggaaacttttgattgtggcgataaaattggttatatggaagctttcgtagaatatggtattcgtcacgaaaaattaggtaaagaatttaaatcctttatcaaaaatttggcaaaaacgctataaatagcactaatacaaataaaatggacaaaatgaaagattttgtccatttttgttttattattaatatagaatattgctttatgaataaatatgcacaataatagaataattaattaaaacaaaaaggaaaaattatggcactttggggtgggcgttttacacaagccgcagataagcgttttaaagattttaatgactcattacgttttgactatcgtttggcagaacaggatattcaaggctcaattggctggtccaaggccttagtaaaagtgaatgtattaactgttgaagaacagcatcaacttgagcaagcactaaatgaattacttgttgaagtgcggtcaaatccgcaagcaattttacaagatgatgctgaagatattcatagttgggttgagagtaagctaattgataaagtaggcaaccttggtaaaaaattacatactggtcgtagccgcaacgatcaagtggcagtagatataaaactgtggtgcaaacagcgtgtggttgaattacaagaatccgtgcgtaatttgcaacgccacttagttcaaaccgcagaaaacacacaacaagcagtaatgcctggctacacccatttacaacgagctcaaccaatcacttttgcccattggtgtatggcatatgtggaaatgttcgaccgcgactattcacgtttaacagatgcgtataatcgtatgaatacttgtccacttggtagtggtgcgctggctggtacggcttatgctgtagatcgtgattcacttgcgcacgatcttagttttgctttcgcaactagaaatagcttagatagcgtctctgatcgcgatcatatcgtagaattactttctatcgcctctcttagtatggcacatctttcccgctttgctgaagatatgattatctttaacagcggagaagcaaatttcgtggaactatccgatcgtgtgacttctggttcatcattaatgccacaaaagaaaaatcctgatgcttgtgagttaattcggggcaaaacggggagagtaattggttcattaacatctatgttaatcaccttaaaaggcttgccacttgcgtataataaagatatgcaagaagacaaagagggcatttttgatgccttagatacttggcaaaactgtgtagatatggcaacgttcgtcttagatgaattgaaagtaaatgttgaacgtactcgtgaagctgcgttaaaaggatattcaaacgcaactgaattagcggattatttagtctctaaaggcgtacctttccgagattcccatcatatcgtgggcgaaacagtggtttatgcaatcgagaaaggcaaaggattagaagatctgactatccctgaattccgccaatttagtgaagtagtgggagatgacgtttacgagattctttctctccaatcttgcttagacaaacgttgtgcaaaaggtggcgtatcgccattgcgtgttgccgaagctattgcagaagccaaaacaagatttgcttaattaatattataacttagagatcacattggattttacaagcctctaagtaccacctatttataagcaaaaacacttaaataagatgataaaaacaaaaagtgcggaaaaaaccaccgcactttttatctcaattaggaataatcaatgaccaatcaacaagactatactcaagacaatgacaaactttaccgttatcttttccaacatcgtgcagttcgtggagaatgggttcgcttaaataaaacatttactgatacattaaatacccatcagtatcctaaagcagtacaggatttattgggagaaatgatggtagcgactaatttactcactgccacactaaaatttgccggcaatattaccgtacaaattcaaggcgatggcccattacgcttagcattagtaaatggtaatgatcaacaacaaatccgcgcccttgctcgagtggatggcaacatcactgaaaatatgagtctgcataatatgattggtaaaggcgtattggtcattactattgcaccaaaagaaggcgaacgctatcaaggtgtaattagcttggataaacccacgatcacggaatgcttagaagattattttgtacgctcagaacagcttcaaactcaattaattattcgtactggagaatatgaaggcaagccagtggcagcaggtatgttattacaaattatgcctgatggttctggtacaccagaagattttgagcatttaactacgctcgcagcaacagtaaaagatgaagaattatttggtctccctgcagaagagttactctatcgtttatatcacgaagaaaccgtcaatctttatccagcacaagatgtacaatttttctgtggctgctctgctgagcgttctagttctgcattactgctcatctctgatgaagaaattgacgaaatattagccgaacataaaggcagtattgatatgcaatgtgagtgttgtggtacacactacttctttaataaagaagcgattgaaaaattaaaatcaacaagagtttaaaaacaatcccgacacaatgtcgggatttttgctctatatcacaatatcactaaaaagaggtaaagttcttaaaaaaatgtttaaaaatgagatctacttaacatttttttatattgacatccattataataagccacagttaaattttaatcttacatattagaggtgacttatgacagacttaaataaagtggtaaaagaacttgaagctcttggcatttatgacgtaaaagaagttgtttacaatccaagctacgagcaattgttcgaagaagaaactaaaccaggcttagaaggctttgaaaaaggtactttaactacgactggtgcagtggcagtagatacaggtatcttcacaggtcgttctccaaaagataaatatatcgtgttagatgaaaaaaccaaagatactgtttggtggacatctgaaacagcaaaaaacgacaacaagccaatgaaccaagctacatggcaaagcttaaaagacttggtaaccaaccaactttctcgtaaacgcttatttgtagttgatggtttctgtggtgcgagcgaacacgaccgtattgcagtacgtattgtcactgaagtagcgtggcaagcacattttgtaaaaaatatgtttattcgcccaactgaagaacaactcaaaaattttgaaccagatttcgttgtaatgaacggttctaaagtaaccaatccaaactggaaagaacaaggtttaaattcagaaaactttgttgctttcacttggactgaacgcaacaaagttttctgaatttaaccttgttctttccagtttggattggttactttagaaccgttcattacaacgaaatctggttcaaatttttgaggttgtcttcagttgggcggataacatattttttacaaaatgtgcttgccacgctacttcagtgacaatacgtactgcaatacggtcgtgttcgctcgcccacaggaaccatcaaactacaataagcgttttcgagaaagttggtggggtacnagtctttttagcctggcttggaggctggtccaaaggcttgtgggggtttcagcagtttnggtgtcnncaaaagaccnnngggcttcttcttgccgcccgttttttantccttgtacgcctccggngganttctctcaaattgtcctgnggaggaacactttttntgtagacaggtgtggtttctccctttntatgtacagcactananaagaaaaaaaactcgttctactcacnaatcaaaaaaanatnnnnnancatttacatctttaagctcanccnntntggaggaaagaacacgtatgcatcnnnannaancanagntnnccacnnnttactaaaaaacnnantntnannttaaanntnctcttnatggccatcagcttttcctactcgcctccctnnncnnncctannancnacancccnccgcnacatnngtcttcttccnnncttttngnnnnttnttnntttcttaaatatnngaatataatntcctcattcaattatcccanantttnnnnctcaccatcccntaatactcngttnatgaaccttnccacaacccactcgcttgcccacntacatcacttctccannttnnnnacannatnncnnnntaatttntccttct

SEQ ID NO: 678 - DNA, 28590 bp, H. influenzae
ggagagaggacggatgagaagagacgatggggggggggggcggaaatcaataaaatgggtgaatgggcgataataggccaggtgttctagaagaggttgtgttaccaagaagaagaagagtgtagtggtaaaagggaagaaagaaagggtaaatggaggggaaagggttgataacgggcgaagggtatgaagctaagccggtgaaacagagttacgagggcggaggttgagaagaagttggtaaccaaccagatttggtcgtagacactaaatttgtatgggatggtgtctgtggtgcgagggaaacacaacagtagtggcagtacgtattgtcgactcaattagagaggcaaggcgcgttttgtagaaaatatgtttattcgccgatataaagaacaggctcgaaagttttgatccagatttcgttgtaatgaacggttctaaagtaaccaatccaaactggaaagaacaaggtttaaattcagaaaactttgttgctttcaacttgactgaacgcattcaattaatcggcggtacttggtacggcggcgaaatgaaaaaaggtatgttctcaatgatgaactacttcctacctctcaaaggtgttggtgcaatgcactgctcagctaacgttggtaaagatggtgatgtagcaatcttcttcggcttatctggcacaggtaaaacaaccctttcaacggatccaaaacgtgaattaatcggtgacgatgaacacggttgggatgatgttggtatctttaactttgaaggtggttgttatgcgaaaaccattcatctttcagaagaaaatgaaccagatatttaccacgctatccgtcgcgacgcattattagaaaacgtggttgttcgttcagatggttctgttgatttcgatgatggttcaaaaacagaaaatactcgcgtgtcttacccaatttatcacatcgataacattgtaaaaccagtttctcgtgcaggtcacgcaactaaagtgattttcttaactgcagatgcgtttggtgtattacctccagtatctaaattgacaccagaacaaactaaatactacttcttatctggtttcacagcgaaattagcagggactgaacgtggtattactgaaccaacgccaactttctcagcatgtttcggtgcagcatttttaacgcttcatccaactcaatatgcagaagtgttagtaaaacgtatgcaagcagcaggtgctgaagcttacttagtgaatactggttggaatggcacaggcaaacgtatctcaatcaaagatactcgcggaatcattgatgcaatcttagatggctcaattgaaaaagctgaaatgggcgaattgccaatcttcaacttagcaattcctaaagcattaccaggtgtagattctgcaatcttagatcctcgcgatacttacgcagataaagcacaatggcaatcaaaagctgaagacttagcaggtcgttttgtgaaaaactttgttaaatatgcaactaacgaagaaggcaaagctttaattgcagctggtcctaaagcttaattaaaaatactaaaaatattaaccgcactttgggtaactgaagtgcggtcattttttatctgttttcaagctgataaatgtattcaaaaatttaaaaaaatccagtaaaatcacggcgttctaactttcatcaattaaaaaggacaatgcaatgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttctaatcatcaaaaaatacgaaaggcagacagttttgtctgcctttattttattaggtatgcgaatttagacgtaccaatgaaaatataatcaacaaagtgcggtaaagattctatgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaatttctgtcgattcagctacaatgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaatagacctagaataactaggtctagtttattcgatttaatggaatacaaattccaaaatgcacatataggctgcaatacaaaataaaataatcgccaataattttcttgttaaaactggattcattaatccacgcaatttcattgagaagaaactcattccaaatgaacccaaggtaacgacaccaactacaagaaagtttacatatcctagttggccacttaggctgatatcatagggaaaagctctagtgagatagccgtatagattaccaataccaccaataatcatcatatagttcgtataaacggcaatttgttgcgtttttaccccctttaattgcccgacaaggggcgcaagaatagaaccgcctccaatacctgtaatacccgcaattaagcctcctccacaaaaactaatactacctttagctcgttctataggagacatattaaacacttctatttgtattctcgatctgttcaaaaatgttttaatcgctagtgcacttaaactaaccgtaaaaattaaactaattatcgctgtagaaaaataaaaacttaattcaaaaccaatttgcaccccaatcaccatagcaatagaccataaaatcatattgatataatcaattttaattttttgcttatggaaaaataataaattaatcaatgcggtacacatcacaatggtgagtgacgtagctgaaataacttgaatcggtaacgcaggaaacaatgtacgtaaaattggcaccatcaataccccaccgccaataccaaaaatagcagaaaccatattggtacaaataccgcaaatcagtaagataaaaattgtactaaacgccatcttagatcctatttaaaaattcatttaatcatacttcattttgacgtaagagcatatgcgcaacttatgatcgctatcatatacagttaaaattattctgctatgataaaaagaataaggaggatacgtagatatgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttttaattaatatttttgatgaatggtatgccaatgatgtcggcaaaattggtattcaatttattgaacaatggtttatggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaataatatttatctagttcaaaattttgttaaacacttcacattttcataatttgcttatagaagaaaaatatagaaatttgtatagtaatctaaagttattgatatattaaaagacgcctttatgtttacattgtcctattatctaccacaaaacttaaataaatgtattatttctgagagtaaaactctagaaaaaaacagcttaatttatgcacaaggcgagaagcctaaagaattttattttttaaaacaagggctagttggtctgtatcatagtctggaaaatggcaaagaaacattgactcgactttatcacgctaatgaatattttggttttcgtactatttttagtgaaacatcttatcattgcagtgcaaaagtattaatggaagccgatatagttagaatatttcctggtaatcacgcaaattttattgcaaataaccctgatttttcttgttatcttatgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctcttaaaatttaccactgctcgctgattgtaaataatatatctaagtaatgattaaatcagataaagatttttgtaatatataaaataaaaaagcccactatataaagtgagcttctttttagaattaatttttattcctcagttgttgcctcagcaacttctggacgatcaactaactcaatgtatgccattggtgcattatcgcctgcacggaaaccacatttcaaaatgcgagtgtaaccacctgcacgttgagcaaaacgtggacctaattcattaaataattttgcaacagtttcaacgttgcgagtacgagcgaatgctaaacgacggttagcaacgctatctacttttgctaatgtaattaacggttcaactacacggcgtaattctttagctttaggcaaagtagtcttaatgatttcatgactaactaaagcacttgctaagttacggaacatcgcttgacgatgactactattacggtttagttgacgaccactcttacgatggcgcatgatcttatccttctcagaaaaatcttaacctatgaccaaactagtcttcagcaatacttgctggcggccaattttcaaggcgcataccaagtgacaagccacgagaagcaagaacatccttaatttcagtaagagatttcttaccaagattaggggtttttaataattctacttcagtacgttgcactaaatcaccgatataatgaattgtttctgctttcaaacagttagcagaacgaactgtcagctctaaatcatctacaggacgtaataaaatcggatcaaattccggtttttcttccttaatctcaggctgacgaacatcacgtaaatcaacgaatgcatcaagttgctccgccaagattgttgctgcacgacgaattgcttcttctggctcaagtgcaccattagtttctaactcaataacgagcttatccaaatctgtacgctgctcaacacgagctgcctctacattatacgcaattcgttcaaccggactataacaagcatcaacaagcaaacgaccaattggacgttcttcttgcgtatgtgtacgagatgaagcaggaacatatcctctaccacgctgaacacgtatacgcatactaattgaagcgttttcatcagttaaatgacaaatcacatgatctggatttacaatttcaacatcaccatcatgggtaatgtccgctgcaacaacagggccaattccagatttatttaatgtcagaataacgtcatctttattctgtactttaaccgctagacctttaaggttcaaaagtacttcaagaatatcttcttgaacaccttccttactactatattcatgcaatacgccatcaatttctacttcagttacagcacaacctggcattgaagacagaaggatacgacgcaatgcattacctagagtatgaccaaaaccacgctctaacggttctaagatcactttagcatgtgttgaactaatttgttcaatatctactaaacgtggttttaaaaattctgtaacagaaccctgcattttatcctctctttggttttaagcttaactattatttagagtaaagctcaacgatcagatgttcgttaatatctgctgataaatcagaacgttcaggaacacgtttgaatacaccttccatttttgcagaatcaacttctaaccatgttggtttttctctttgctctgctaattctaatgatgctttaatacgagcttgttttttcgatttttcacgaatagcaactacatcatttacagaaacttggaaagatggaatattaacaacacgaccattcacaacaattgctttatgactcactaattgacgagcctctgcacgagttgcagcaaatcccatgcgataaacaacgttatccaatctaccttctaataacactaataaattttcaccagtgttacctttcaaacggtttgcttctttatagtagttacggaattgacgttctaaaataccatagatacgacgaactttttgtttttcacgtaactgactaccatagtcagacaaacgcggtttacgagcaccgtgctgacctggtgctgtatcaattttacattttgaatcaatcgcacgcacgcctgatttaaggaataaatcagtgccttcacgacggctgagcttgagtttaggacccaaatatcttgccattttctttctccaactatcctatacgtcttaaacacgacgttttttcggtggacgacaaccgttatgaggaatcggagtcacatcagtaatattcgtgatacggaaacccgctgcgtttaacgcacgaattgtagattcacgacctggacccggacctttaaccataacttccaagttctttaagccaaattctttaacgatttcagcacaacgctctgccgcaacttgcgctgcgaacggagttgatttacgagaaccacggaaacctgaaccacctgcagttgcccaagctagagcattaccttgacggtcagtaatagtaacgattgtattattgaaagatgcgtgaatatgtgctacgccatctacaacttgtttttttacacgtttacgtgcacgaactggtgttttagccattcttatttaccccgactattttttgatcggcttacgtggacccttacgggtacgcgcattagttttagtacgttgaccacgtactggtaaactacgacgatgacgtaaaccacgatagcatcctaagtctaaaagacgtttgatgtttagtgttacttcacgacgtaagtcaccttcaacggtaaatttaccaacttcgtcacgcagtttgtcaatctgctcttcagacaattctctgatcttaacatcttcagcaatacccgctgctgcacaaatagcttgtgaacgagttttaccaataccgtaaatggcagttaaagcgattacagcgtgtttatgatcaggaatgttaatgcctgcaatacgggccactatgcactcctatattttaattaatttgatattctgatcttgaaaagcccgttttcaggatactcaaacagaatatcaaggacataaatgagttgagcagtataactactcaactggttcttggcaagaaaaatgttaattaaccttgacgttgtttatgtttagggtcgctacacaatacgcgtacaacaccctcacgtttaacaatcttacagttacgacacattttctttacggaagcacgaactttcattgcttatccttttactttaaatgaacaattattgtccaaaacccttaaggtttgcttttttcaacgcagattcatattgagaagacattaaatgactttgaacctgaacgatgaaatccataattacaacgactacaattaaaagagatgttccaccgaagtaaaatttaacatcccaagccgatgtcataatataaggaactaaacatacaaacgttacatagagaccgccaattaatgtaagacgagtcatcactttatcaatataacgtgatgtttgttcaccgggtctaattcctggaataaatgcaccagatttttttagattatctgctgtatcacgaggattatattgcattgctgtatagaaaaaactgaagaaaataattgcaacagcataaacaagcaaataaagtggttgaccaggattcaataacattgataaattatttaaccattcaaatttatcattttgcccaaaccattgtgttaatgtagctgggaataaaataatacttgaagcaaaaattgctggcattacatttgccatattcactttcaatggtaaatgtgttgaatgaccacctaaaatttgacgaccttgctgacgcttcgcatattcaacgcgaattctacgttgtcctctttcaacaaaaacaacaaaataagttactgcaaatacaatagctgcgatcagaagaagaactaatggatgcatctgtccttgacgagcctgctcaatagtttgaagaatggccgatggtaaaccagctacaataccgccaaaaacaagaattgaaataccgttaccaatacctctttcagttatttgctcacccaaccacataaggaacattgtcccagtgactaaactaacaactgaagtgaagtaaaaactaaatccaacatttggcactaagccagacaacatatttggtaagcctgttgaaatagctactgcctgaatcgttgcaaaaacaactgtcgcataacgagtatatttagaaattttacgctgaccagcagcaccttctttctttaattctgctaaagcaggagaaaccgttgcaagcaattgaattacaatagatgccgatatatatggcatgattcctaatgctaaaatggatgcacggcttagagcaccaccagagaacatgttaaacatgtcaatgatagtgcctttttgttgttcaactaattgagctagaacagtcgcatcaataccaggaaccggaatgaatgaaccaattcgataaacgataagtgcacctaaaacgaaaagtaatcggctttttaattcacctttaccgctattagtacttcttgcttgataacctggttgtttagccatttgctaattattcctcaattgaaccgccagcagcttcaattgctgcttttgcacctttagttacacgtaaaccgcgtaccgttactgcagatttcacttctccagctaaaattactttagcgaattggatatctttagttaagatatttgctgcttttaatgtttctaaagttactacattaccttcaactttggttaattcatttaaacgaacttctgcagtcactgcagatttcattgaagtaaaaccaaattttggtaaacgacggtataacggcatttgaccaccttcgaaaccgcgacgaacaccgctaccagtacgagatttttgacctttatgaccgcggccaccagtcttgcctaaacctgaaccaataccacgaccgaggcgtttagcactatgctttgcaccttcagccggagatagagtatttaaacgcatctcttactcctccactttaaccatgtatgaaacttggttaatcataccacgtactgcaggcgtatcaattaactcaacagtgtggtgcatatggcgaagaccaagaccacgcaaggtagctttatgcttcggtaaacgagcaattgagctacgaacttgtgttactttaatagttttagccattattcattaccccaagatttcatcaacagttttaccgcgttttgcagcaaccatttctggtgatttcatatttgctaatgcatcaatagttgcacgaacaacgttaatcgggttggtagaaccatacgctttagaaagaacgttacgtacacctgcaacttccaataccgcacgcattgcaccaccagcgatgatacctgtaccttcacttgctggctgcataaatacacgtgaaccagtatgaacacctttaactggatgttgtaatgtaccttcatttaaagcgacattaatcatattgcgacgtgctttttccatcgctttttggatcgctgctggaacttcgcgagctttaccataaccaaaacctactcggccattaccatcgcccaccacagttaatgcagtgaaactcataatacgaccaccttttacagtttttgatacacggtttactgcgattagcttctcttgcagttcaccaacttgtttttcgatgtttgacatctcaatttacctcattagaactgtagaccagcttcacgtgcagcgtccgctaaagtttggacacgaccatgatatttaaaaccggaacgatcaaaagcaacagcttgaacgccttttgctaatgcgcgttctgcaacagctttaccgactgctgcagcagcatctttattaccggtgtattttacttgctcacgaattgctttctcaacagttgaagcagcggcaagcacttctgaaccgtttggtgcaataacttgtgcataaatatgacgtggagtgcggtgaataactaaacgagttacaccttgctctctcatcatatgacgtgcacgagctgcacgacggatacgagctgatttcttatccatagtgttaccttaattatttcttcttagcctctttgatacgtaccacttcatcagcgtaacgtacccctttacctttataaggctcaggacggcgataagcacgaatatctgctgcaacttgaccgatcaactgtttgtctgcacctttcaacacgatttcggtttgagatggacattctgcagtaatacctaccggcaaagtgtgctctactgggtgagaatagcctaaacttaatgcaattgcgttacctttaagttgagctctgtaacctacacccaccaatactaattttttagtgaaaccttcagtaacaccgataaccattgcattaactaatgcacgtgcagtacccgattgagcatttgcttcaacaaaaccttcacgtggagtgaacgtaaattgtccgttatcttgttttacttcaactgattcatgaattttgcgagataactcgccatttttaccttttactgttaatagctgaccgtcgagtttaacttcaacgccggcaggaatattaacaggtgcctttgcaacacgagacattttcctacctctctattaagctacataacagatgatctcaccgcctaaacctgcttgacgagcagcacggtcagtcataacacctttagatgtagaaataactgcaacacctaaaccgcccataacttttggtaattcatctttacgtttgtaaatacgaagaccaggacgacttacacgttggatgctttctacaactggtttgccttggaaatattttaaagtaatttccaattcaggtttagcaccttctaaaacttttacgctttcgatataaccttcagcagctaatacgttggcaattgccacttttagcttggaagaaggcatattgattgcaactttgttcgcagcttgaccgttacgaatacgggtcagcatatctgcgattggatcttgcatactcattgtactttttctccgattccaaaataaagtggtatattaccagctcgcttttttaaggcctgggatttcaccgcgcattgcagcttcacgaaccttaattcggcttaaaccaaacttacgtaaaacgccatgaggacgtccagtttggcggcaacggttacgttgacgagatgggctagaatcacgtggtaaagtttgtaactttaacactgcatcccaacgatcttcatcagaggcattgacatcagaaatgattttctttaattcaacacgttttgcgtagaatttttcagccaatttaacgcgttttacatcgcgtgctttcattgattgtttagccattataacctgccttatttacggaatgggaaattaaaggcagcaagtagtgcttgaccttcttcatcattcttagcagtagttgtgatagtgatatctaaaccacgtacacgatctactttatcgtaatcgatttcagggaagatgatttgttcacgcacacccatgctatagttaccacgaccatcgaatgatttcgcacttaagccgcggaagtcacgaatacgtggaacagcaattgtaatcaaacgttcaaagaactcccacatacgctcaccgcgtagtgttactttacaaccgattggatatccctgacggattttaaagccagcaacagatttacgagctttagttactaaaggtttttgaccgctgattgctgctaagtccgctactgcgttgtctagcaattttttgtcggtcaatgcttcacccacacccatattcagggtaatcttttcgattcgtgggacttgcatgacagatttgtagccgaatttattttttaattcgcttactacttgatctctgtagtaatcatgcagtttcgccatcgcattactccagtttgttagataatttcattgttagatttgaagaaacgtacttttttgccgtcttcgaatctaaaacctacacggtcagctttatttgttttaggattgaaaatcgcaacatttgaagcgtcaattgcagcttcttttttcaccaaaccaccagcctttcctaatgcaggaactggtttttcatgcttagtaatgatgttgataccttcaacaaacactttaccgtttggtaacactttagttaccttgccacgcttgcccttatctttaccagtaagaacaattacttcatcattttgacggattttagcagccattacattccccttacagtacttctggagctaaagaaatgatcttcatgaatttctcagaacgaagttcacgagtcactggtccaaaaatacgagtaccgattggttgctcagtgttattatttaaaattacacaagcgttaccatcgaaacgaataactgagccatctgggcgacgaacacccttcttggtgcgcacaacaactgcttttaatacatcacctttttttactttaccgcgtggaattgcttcttttacagtaattttgatgatgtcaccaatcgcagcataacgacggtgcgatccacctagaaccttgatacacattacgctgcgagcgcctgaattatcagcaacatccagcatagtctgttcttggatcatattagtgctccgttaagattaaaaaaacaccctttcgggacgaacccatccacactattcagatagaatggcagataggcggcggattttatcaaaagaaaaagagaaaggcaatgataatttagcttcctcttattgatctatttactaaataatccagttaaaatttaccgcacttttggaattataaaaatatcctcatcctctcaaaaatttatcgaatgaaaaataaactgcagaaaaaatgaaacgctctcttctcttaccttagataaattcatcagttttcagattttgggaaaatttccttgcctaaaagccaaagatacagatcgagctcttttaagttaaatctttctaatttataaaatctttgaaaatctatcaaaatctctttaaattttctgtaattttttaaatctttccttttaaaggctgaaaatttatctactttattaaaatagaggagatcttgctccacatagctatcataaattgggaaagcaattggattatgatgactacaatatttagttgcaaaagagtaaaaatacttctccttaccaccaattgttacttctcctaattcacgaactaattcaatatcaccagattttaaacgtttatctagatctttaatacccaaaatatgctttgcaacatgatgaatagcaaatatatttgtactataaacattgttaggaatatttatattatcaagcactggctctataaaagtatcatctaacaaatataatcctgttacatattctcctaataagattctaaaagtctctcgatcatatatatctgcttctgtatccaaatcattttcatcataaaactctgtgatgccaatctcctcttcttgataaggaagatcatgtattaatatatacttcattgtatcagataaatgacaccaccaatcccaatcttcattagaaatattcccagtagtatctgtatcattgataagttcttctgggaatttatcctctgctaattttgacgtttctttacgggtatcaacgccgttgatgaaattaattaatctatgtcccaaataacgagtattccactcatcagaatattcaaaaccaagatcttcagaaatttctcttaagtaccattattaaaaatatttttttcagtatttgtttaggtgttatgtcaataacacctaaaagaaaaagtgcggttaaaattcattgaattttaaccgcactttaaaaacaaaaaagccaatagatttacactattggcttttattttattactctttgttattaattaagcaataactgctttctcaacaacacgaactaaagtccaagatttggtttttgatagagggcgacattcgcgaatctctacggtatcaccaactttggcttcattgttctcatcgtgtacgtgtaatttagttgtacgacggataaatttaccatataaagggtgttttaccttacgttcaatagcaacaacgaaagatttttccattttgtcgctaacaactttaccttgtacgctacgaattttatcagtcattactcacccgccttttcggttaatacagtttttacacgtgcaatatcacgacgcacttgcttagcctgatgggtttgttgaagctgaccggtggctgtctgcatacgcaacttgaattgttcacctaaaaggtttactaattcagcattcagctcttcaacactttttgtacgtaaatcttgagctttcattacatcaccgtcttagttacgaaagtggtcttaactggcaatttagcagctgctaatgcaaatgcgtttcttgctacttcttcagacacaccatccatttcataaagcactttacccggttggattaaggctacccagtactcaacgttacctttacctttacccatacggacttctaatggtttttcagtaattggtttatctgggaatacacgaatccagattttaccttgacgttttactgcacgtgacattgcacgacgtgccgcttcgatttgacgagcggttaaacgacaacgaccaactgcttttaaaccgtaagtaccgaaactaacttcagtaccgctcgcgataccacggttgcggcctttgtgaactttacggaattttgtacgttttggttgcaacatttagcgtttctccttacttacgacctttaccgcgaggagcctttttaggcttgtcggcaggttgttgttctgattgcgcaacggcagccattccaccaagaatttcacctttgaagatccacactttaacgccgattacgccgtaagttgtatgagcttctgcagtgttataatcgatgtccgcacgaagagtatgtagaggtacgcgaccttcacgataccattctgaacgtgcgatttctgcaccacctaaacgaccgctaacctcaactttgatacctttagcacctaaacgcatagcactttgtaccgcacgtttcattgcacgacggaacattacacgacgttctaattgagaagcgatgctatctgcaactaatttcgcatctaattcaggttttttcacttcagcaatgttaatttgagcaggaacgccagcgattttagacactgcgttacgtaatttttcaacatcttcgccttttttaccgattacgataccaggacgagctgtgtgaatagttacacgaatacttttagctggacgctcaatagtaatacgtgaaactgaagcatttgctaattctttatttaagaatttgcgtactttgaaatcgccttcaagattgtcagcgaagtcttgtgtattcgcgaaccaagtagagctccaaggtttaacaatacctaggcgaataccatgtggatgtactttttgacccattgctattcctctacttattaacgatctgacacaaccacagtaatgtggctagtacgttttaaaatacgatctgcacgacctttagcacgtggcataacacgtttcatgctaggaccttcatcaacgaagattttagcaactttaagatcatcaatatctgcaccgtcattgtgctctgcatttgcaatagctgattctaaaactttcttcactaaagctgctgcttttttgttagtgaaagttaaaatttctaatgcttgcgcaacttttttaccacgaattaaatcggcaactaagcgagctttttgggcagaagtgcgagcgtaacgatgttttgcgatagtttccatctctttacctcttatttcttagctttcttatctgccgcgtgaccgcggtatgtacgagtcggtgcaaattcaccaagcttatgaccgatcatttcatcagatacataaacaggaacgtgctgacgaccattatggactgcgatggtcaatccgatcattgatggaatgatcattgaacgacgggaccaagttttaattggttttttatccccgctttccaccgccttctctaccttcttcaacaagtgtaggtcaaggaaaggacccttcttgagagaacgtggcatggctaatcctctttaatttaatctattatttgccacgacgacgtacgatatatttatcagtacgtttgttgtgacgagttttcttacctttagtttgaacgccccaaggagttactgggtgtttaccaaagttacgaccttcaccaccaccgtgtgggtgatctactgggttcattgcagtaccacgaactgtagggcgaatgcctctccagcggttagcaccagctttacccaatacgcgaagcatatgttctgagttaccaacttcaccgattgtagcaacacattcagctaatactttacgcatttcgccagaacgtaaacgtaaagttacatagttgccttcacgtgcgatgatttgtacataagcaccagcagaacgagcgatttgaccgcctttacctggttttaattcaacgttatgtactgttgaaccaactgggatattacgcattggtaatgagttacccactttaattggtgagtttatgccagcttggatttgatcgcctactgacaaacctttaggtgctaaaatataacggcgttcaccatctttataaagcactaaagcaatgttagcagaacggtttggatcatattctaaacgctcaacaaccgctggaatgtctaacttgttacgtttgaaatctattaaacggtagtgttgtttgtgaccgccaccaatgtgacgagtagtaatacgaccatagttgttacgaccaccagttttagatttagtatctagaagaggtgcgtaaggttaacccctgtgtaaacaggggttcccgattttaacaacgtgacggcgaccagcggaggtcggcttccattaacgatagccattctctaatctcctccgatgactgtgcactgtccacgaagtccaagttttggccttcggctaaagttacataagctttttcccagtcggtgcggcgacccaatttgtttccgcggcgtttagttttccctttaacaacctcagtacggactgaatctacttttacttcaataattgagcaaccgcagcagcaatttcagctttgttcgcatctaaagcaactttaagtacaacagtgttagatttttcagcattgttagttgctttttcagagatgtgcggtgcacgtagcacacttagcaaacgttcttgactcatgctaggatctcctcaatttgtttcacagcatcaacagtaacaatcactttatcgaaagcgattaagctaactggatcgataccttgaacatcacgtacatcaactttatataagttacgtgcggctaagaatagattttcatctaaacttgctgtgataattaacgcatcttcaacggctaaatcttttaatttttgtactaaaactttagtttttggtgcatctaattcaaatttttccaccacaaccaaacggtcttgacgaactaattcagaaagaatgcttttgatagcaccacggtacattttcttgttcactttttggctgtgatcttgtggtttagccgcgaaggttgtaccaccagaacgccagattggtgatttaatatcaccagcacgagcacgacctgtacctttttgacgccaaggttttttacccgaaccagacacttcagcacgagttttttgcgcacgagtaccttgacgcgcacctgctgcataagcaacaacaacttggtggatcaacgcttcgttaaactcacgtccgaaggtagtttcagaaacagtgagtgcgtttgcacctacaacttgtaattccatctctatctcctagacttatgctttaactgccggcttaacgataacatcgccattgatagcaccaggtacagaaccttttactaatagcaatttacgctcagcatctacacgaacaacttcaagtgattgaacagttacacgttcagcacctaaatgtcctgccatttttttacctttaaacacacgacctggtgtttggttttgaccaatagaaccaagtacacgatgtgataaagagttaccgtgtgtagcatcttgagtacggaagttccaacgtttaacaccaccttggaaacctttacctttagaagtaccagtaacatctacttttttaacatctgcgaagatgtctacattgatttcttgacctaaagtgaattcttcaccttcagtacgaaattcccataaaccgcgaccagcttcaacacctgctttcacgaaatgacctgcttcaggtttagttacacgattcgcttttttagaaccagtagtaacttgaactgcagtatagccatcgttttcaagagttttaacttgagttacgcggttggcttcaatttcgataacggtaactggtactgacacgccgtcttcattgaagatacgggtcataccaactttacgaccgactaaaccaatcattgtaataacctcttaattaacctaggctgatctgcacgtccacgccggcagccaaatctaaacgcattaatgcatcaacagttttttctgttggctctacgatatctactaaacgtttgtgagtacgaatttcgtattggtcacgtgcgtctttgtttacgtgtggagaaatcaacacggtgaaacgctctttacgagttggtaaaggaattggaccacgaacttgtgcgccagtacgtttagctgtttctacgatctccgcagtagattgatcgatcaaacggtgatcgaaagcttttaagcggatacggattctttggttctgcattagaccagagctccaataaaatttagctaataaaaaaactaacaccaatcacaattctaacttcaaatatagaaaaggaggtgcaagttacctgttatatagtctccaaatcggaaacattgttagcctgacatatcgtcatgcccgttcaataaatgattacattaaacggctctcatattgagagtccgtgtattctatagaaagacaaccctatttgcaagcttttattttaactattttgttggcctaaaagcctctaataatttatcaaaaatatattcttcaaggtgtgtgtaaaccgtttttctttgacgacatagtgtcactttccacggaacaggactttcgattttacgacacaaaaattcttttgaatgataaagctcagccataggtaacggtagaatagttaataattctttgtttgttttgaccgcacttagcagaaaatcccaacaactcgaatccaaaacaatatctggataacaattattgcgctcaaaagcttccttcaaatgatgatgaatcataaatgtttgatcaaaaattgccattttctgctgatgtaaatcagcccatgtgatttgttgtttttttgctaagacatgctttggtgaaagaaataaggctaattcagaactatgaatttcaattgaatcaataatattttttgatattcgctcgggatataacaacacggctaaatcaactttatctaaaagaagttcactctttagagcataagctccaatttctttaataataaaattaatatctggattcttaagaataagatgaggcaatacagaagagaacacggctgataaaactaagggaggaataccaattgttatcgtgcctttcttacaatcttttgatttataaagatttgttctcatatcattgtaacgcttgatcacttcttttgcatcacgataataattttcccccgcaaaggttagtccaataatttttcctgatgcccgtttaaatatctgaatattttcacgattctcaaactccgtaatcatcatacttaatgcaggttgagacacatataaattttgagacgctcggcttaaattaaaatcattatctacgattgaaacaaaatatcttagatgcctaatatccatcattttcacccccctaaggactgccatttttacaaaatatagcacaaggattgtttaaaacactatcaaaataacttatacccgcctaagaaagatgtatttcttttacgaaattttttttgctatttttaatatcaatctagttcctttattgcctatcaaggatcatcacaagaaacatatccatttgaaatataagatacttatttgttgatattctttcttttaatctcgttattaggaggtctctatgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaataaggagaacgccatgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactttaattatgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaattctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatagaaaaggagttaaaaatggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgcttataactatttacttcctaaactacaacagcgaaatatttcacttctaactaaaaaagcgaatttcttttaagaaattcgcttttcttttgatatccaattattctttcctctccatcatcgcaatatgccttgtcgcggcaatccacgccccaacatagcccataattaaacagcacactaataagaatacaaactcgccaacgcctaatccattcaaactgaattggacggcaaaaatatccgttacgtatttcactgcagaagtaaaatagctgataataaaactactaaaaattgctgcaactaacccacctaacacggcataaatcatccccgtataaagataaggacgaaggataaactgatctgttgcaccaagcaatttcatcacatcaatacttgagcggctactgtacacatcagagcgaatactgttaccaataactaaaaataccgctatcgtcattaataccgtacagaaaattgccacatgggcggttaaccaagaaagtgcggttaatttttccatccaatcattatccaagcgaacttcttgtacccctttgattttatttaaattggtacgtaactcatcacgtttttctgacacattaaattcgctcgtcggttttactatcacgaccgcaggcaatggattatcatctaaaatttccaattcttcgccaaagccagaccagcttttaaattcctttaaactttcttgacgagaaacataattcagtgattctacgcctttttgctggcggattttttctaccactaaattcgcgttttcctcacttaaatttttatgaagataaatagtcaattcactgtcaggataaaattgagtggtggctaaatgcaaatttttccacattaaatagctcacagtcgggatcgtaagcgaaacggcaatcactaaaatcgtgagcagcgtgccaaatttacgttgccataaatccgcccatactgcacgcaaagtataggctgtttgaacaaaaacagatgcatccgttgatcggctcatgattattccttaataacgtaaataaccttgttcaagcacaagacaaggttttggtttttgttgaattaaattaatgtcgtgagtagcgattaacacagtcattcctagacgattaaattcttcaaacaaattaaaaatgcctaaagaaagttcatcgtctaaattacccgttggttcatctgctagtaagagctgaggtttatgcacaatcgcacgcgcgatatcaacgcgttgctgctcaccgccagaaatttgtggtggcaaatagtgtgctttattacgcaatcctacacgatctaaagatgccatcgcacgtgtatgcgcatcttttggatgcatacctgcaataatcaatggcaatgccacattttccgccactgtacgatctgttaataaacgataatcttggtgaaccatgccaatttggcgacgcaaaaatggaatttcatattttgacaagcgagtaatatcgtgtccgttaaaccaaatctgaccagcattggctttttccatccccataataagcttgagtaatgtacttttccctgcgcctgaatgcccaactaagtaagtcatacttcccactggaagatgaaaattcaagccttgtaaggctggctgcgttgcaccatgataggctttagaaacatttgagaacttaatcacaatttttccttattctttttattcttcttcatgaacgaataatgcctcaataaattctttcgcattaaactcacgtaaatcttcaattttctcgcctacaccgatatagcgaataggcaacttaaactgatcggctatggcaaaaatcacgccaccttttgccgtgccatctaatttagttagagagatccctgttaaacccacagcctcattaaataatttcgcttggctaatagcattttgtcccgtgccagcatccagcgtaagcataatttcatgtggtgcagtttcgtcatattttttcataacacgaacaatttttttcagttcgtccattaagttatttttattttgtaaacgacccgccgtatccgcaataagaatatcaatattgcgtgcagccgctgattgcatcgcatcaaaaatcacagacgcagaatcagaacccgtgctttgcgcaacaactggaatatgattgcgttctccccaaacttgaagctgctcaacagccgctgcgcggaaagtatcacctgctgcgagcatcaccgattttccttcagcctgaaatttacgtgcaagtttaccaattgtcgtcgttttacccacgccatttacgcccaccattaaaatcacataaggttttttcgtgctatcaatctctaacgggccgggctactggctcaagaatatccgccatttctacttttaattgttgatataaaagctcggcatcttgtaattctttacgacttgcatggtcagtcaaatttttgacgattttacttgttgtcggcacgcca

SEQ ID NO: 679 - DNA, 23298 bp, H. influenzae
  misc_feature (22529)..(22529): n is a, c, g, or t
  misc_feature (22531)..(22533): n is a, c, g, or t
  misc_feature (22539)..(22539): n is a, c, g, or t
  misc_feature (22542)..(22542): n is a, c, g, or t
  misc_feature (22544)..(22544): n is a, c, g, or t
acgtaaccacggattattacacagtggtgcacgttacgccgtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaaataaagtacgttgtatcaacactcgtttgctagaaaatgaagaaatcactgcagataattttgtactagcttcaggaagtttcttcagcaaagggcttatttccgaatttgataaaatttatgaacctgtttttgaatctgatattatcggtgttgaaggtttcaaccagaaagatcgtttcacttggactgttcatcgctttgcacatccacaaccttatcaatcagcaggcgtagcaattaatgctcaatgccaagtgcaaaagtgcggtcaatttttaacgaatttatatgccgtcggtaatgtgattggtggttttaatgcccttgagcttggttgtggttcgggtgtggctgttgtaactgccttggcagtggcagatgaaatcttagcgaaataaggggaataatatggataataatattcaacgactcattgatagtgcaaaacaatcccttaattcgcctgaaagccataaatatatcgacgaaagttttgaaagctgtattaaatgtacggcttgtactgctgtttgtccggtttcacgcaacaatccgctttatcctggtccaaaacaatcagggcctgatggcgagcgtttacgcttaaaatcagcagaactttatgatgaagcacttaaatattgcaccaactgtaaacgttgtgaagtggcttgtccgtctgatgtgaaaattggcgatttaattgtacgtgcgcgtaataatcacttagcgcagtctaaaaaaccgttaatgaataaattgcgtgatgcgattttaagtaacacagatgttatgggtaaaattaatacgccattagcaccgattgtaaacaccatcacaagcctaaaagccaccaaatttatgttggaaaaaacgcttaaaatcagtaaagaacgtactttacctaaatatgcgtttggcacgttccgtagttggtatatgaaaaatgcgttacaagaccaacaaaaatttgagcgaaaagtagcatatttccacggttgttatgttaattataataatccacagcttggcaaagaatttcttaaagtgttcaatgcaatgaatattggggtaatgttattagaaaaagaaaaatgctgtggcttaccattaatggtaaacggttttcctaatcgcgctcgtaatattgcacaattcaataccgattacattggaaaaatggtagatgaaaatggaatagatgtgattagtgaggcatcaagttgctcgcttaatttacgcgacgaataccatcatattttaggtatcgacaacgccaaagtccgtccgcatatccatatggtaaccccatttttatatcagcttttcaaagaaggtaaaacattaccgttgaaaccacttaaacttcgagtggcttatcacaccgcttgtcacgtagataaagctggttgggcaccttatactttggaagtattgaaaaaaattccgggtttagaaatcattatgttaccaagccaatgttgtggtattgcggggacttacggttttaaatcagaaaactatgaaatttcacaatctattggtaaaaatctattcgataatattaacgagggtggatttgattacgttatatctgaatgtcaaacctgtaaatggcaaattgatatgtcatctaacgtaacttgtattcatccattaactttactttgtatgtcgatggatgcttaaataagaaaaatgcacgttgtaattaacgtgcatttttatgattaattttatctatgaaaaaaccgactttatattgataaagtcggtttttaattcagttcaatttaacattaacctgcaacagcaatacgtttcatatctgtcatataaccacgtaattcttgaccgattaattcaacagggtggttacgaattgcatcgtttacatcgcgtaaggtgatgttatcgatttccactgctggagtaggctcgcccaagtcacctttttgaaggttgggtataatttcttttgcaagaattggggttgctacgttagagaataagtagttaccatattctgcggtatctgaaattactacgttcatttcgtataagcgtttacgtgcgatggtgttcgcaattaatggtaattcatgaagtgattcatagtaagctgattcttcataaataccgcttgcaaccatcgcatcaaaggctaattctacaccagctttaaccattgcaatcattaatacaccgttatcaaagtattcttgttcgctaattttgccatcatattttggtgcattttcaaaggctgttttacctgttgcttcacgccatgcgaataaatctttatcgccatttgcccagtctgccatcatggttgcagagaagtgaccgctgatgatgtcatccatgtgtttgtaatataagaaaccaaggctttctttaatttgttcagcaagttcaaatgcacgtaattttgcgctgtttgataggcgatccatcattaatgtgataccaccttgttttaacgcttcggtaatggtttcccaaccgtattggattaatttacctgcgtatgcaggatctttaccgtcagccactaatttgtcataacatacgatagaacctgcttgtaacataccgcaaaggatagtttgctcacccattaagtcagattttacttctgccacgaatgaagattctaaaacacctgctttatgaccgcctgttgcagcagcccaagctttcgcgatcgccaagccttcgcctttcgggtcattttcaggatgaaccgcaattaatgttggcacaccgaaaccacgtttgtattcttcacgtacttcagtacccgggcattttggtgcaaccatcacaaccgtaatgtctttacggatttcttcgccaacttcaacaatgttgaaaccgtgtgaataaccaaatgcagagtcttttttcattaaaggcatcacatcagcaaccactttagagtgttgtttgtctggtgttaagtttacgactaaatctgcagttgggatcaattcttcataagtacccactttaaaaccattttcagttgcacgttggaatgacgcacgtttttcagcaattgcttcaggacgtaaggcatagctaatatctaagccagaatcacgcatattcaaaccttggtttaaaccttgcgcaccacagcccacgataacgatttttttgccttttaagaagtttgcttcatctgcaaattcttcgcgatccataaaacgacaacgacctaattggtctaatttttgacgtaaatttaatgtgttgaaatagttagccattttgttgtccttaattgtgtaaggttgataattgtatgatgttgtgtttgcatattttttgttgtggtttgattataggattttttgttgttgcgtaaagtgatattatgggaatgtaatgttgcgatttgtgcaattatgttgtttttttgtggattgcatcgtatttcgctcgatgagcgacctactttcttttactcgtgtaaaagaaagtaggcaaagaaaacacgccccaattaaatcgcagctctttgctttgtttcaattttcttaacggcaatttgctgaactcgctacgctcaaacaaacgcaaattgcctgaaaattgaaagtcgcaaaggcgatttatatggggctcagaatatatcagagcgttattaaaaagtgcggttagttttctggtatttttttaaatacgctaaattttacccgcactttaaattgaagaaagaacaaattagttcccttctttgccgcctgagaaattggaaacttgtaggaaattttcgtctgtttgagcgtagcgagttcagaaaatttccgttaagcaagttttcaatttctcaggaaataaggcaaagcagggcgtgttttctttttgcctacttttgctttgcatgagcaaagaaaaagtaggtcgccatcggcgaaacccgaaattaaataaaataaaagaagaaattatggaatttaccgacctacaaatattcatccacctcagtgatacaaaaaacttcgccaaaactgccacccaaaaccacatgtctccctctaccctttcccgtcaaattcaacgattggaagacgagttagggaagacactttttatccgtgataatcgccaagtcaaacttactgaatatggcgagaaatttttgcaatttgctaaaacagaatggcaaaactggcaacaatttaaacaacaactgaaagataaatccgatgaattttgcggtgaaattaaacttttttgttctgtaaccgcatcttatagccatcttcctcacgtacttaaagaatttcgccagcgttatcctaaagtggaaattcaactgactacgggtgatccagcgttagcactagaattaattcaagcgcaacaagtcgatctcgcgcttgcggggaaaccaaataatctgccttctagtgtagtgtttcataaaatagatgatattagtttgtccctaattgccccgcgagtggcttgtttggcgacacaattattgcaagaaaaacctattgattggcagcaaatgccttttatttttcccgttgaaggtcacgcacggcagcgaattgaacaatggttaagggagaaacaaattaaacacccgaaaatttatgctactgttgcaggacacgaaggaattgtgccaatggtgggattaggatttggattagcaatgttgcctgatgcagtaattgacagcagcccaatgaataaccaaatttccagacttaatcttgataaacctattgagccttttgaattaggtatttgcacccaaaaaagaaatctcgaacagcccctagtccgtgcattttgggcgatgttagaatagaataaataatggtttaaaataaggatttcttatgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagtttataaatgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttactaacccattcatcaaaaatataagatataaaaaagtgcggtaaaaatttaccgcacttttgttgttattctaattaactgaaaattagtttttcgctgcagctgctgctttaacaattactgcaaatgcaggggcttttaatgatgcgccacccactaatgcaccatcgatgtctggctgagtaaataattcagcggcatttgcatcatttacagaaccgccgtattgaataattacttgctctgccacggcttgtgatttcgctgcgatgtgaccacggataaatgcatgaacggcttgtgcttgtgctggagttgcagatttacccgtgccaattgcccagattggttcgtatgcgatcactgcaccgttgaatgcttctacgcctaatgcattgatgactgcatcaatttgacgcgcacatacttcttctgttttgcctgcttcgttttctgcttcagattcaccaatacataatactggcactaaaccagcttcttttaatgcaccaaattttttcgccacaaattcgtcgctttctttatgataagtgcggcgttcagagtggccaataatgatatattttgcaccgaaatcttttaacatttcgctagaaatatcaccagtaaatgcacctttcacattgatatctacgttttgtgcacctaattgaatcacacttttaccgccacagctgcaaccacaaccagaaagtgctgcttcagccgtacctaaatacataacggggggggcaattgctacatcacaacctgttacatcatgtaattccgcttttaatccctcgattaattctttcgtgaatgctttgctaccgtttaatttccagttacccataactaaaggacgacgtgccatttttgtttctccatagttgataaaattaacttgcttactataccaaaatttcgcccctattctttgcagaagatcataaaattaaaaaaattctcacagaaagatgattatcttgagctaaaaagctacaattacctgtatggaaccaataaaaaataaccaattatgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgctaacagcgttaaatcgttattgggattatttgcggattgaacgccaaatgagtcctcacacaatcactaattatcaacatcagcttgatgccaccatcaaaatcttagcgcaacaagatattcattcttggacacaagtgacgcctagcgtggtgcgctttattttagcggaaagcaaaaaacaaggcttaaaagaaaaaagcttggctttgcgtttatccgcattacgtcgatttctcagttttttagtgcaacaaggcgaattaaaagtaaatcctgccacaggcatttctgcaccgaaacaaggctggcatttaccgaaaaatatggatggcgagcaaattcaacaattgcttgccaacgatagcaaagaacctattgatattcgtgatcgtgctattttggaattaatgtatagttcaggtttgcgtttatctgaattacaaggcttagatttaaacagcattaatacccgtgtgcgggaagtacgcgttattggaaaaggtaacaaagaacgagttgtgccgtttggacgttatgcttcgcatgctattcaagaatggttaaaagtgcgggcattatttaacccaaaagatgaggcattatttgttagccagcttggaaatcgtatttctcatcgagccattcaaaaacgtttagaaacttggggtattcgtcaaggcttaaatagccatcttaatccgcacaaattacgtcattcttttgcgacgcatatgttggaagccagttctgatttacgcgccgtgcaagaattgcttgggcatagcaacctttccaccacacaaatttatactcacttaaatttccaacatctagcagaagtgtacgatcaggcgcacccaagagcgaaacgaaaaaaataaaagagcggttaaaacaaaagaaattttaaccgcacttttaattaatattagattacttcgcaggaatatcggcaagtactcttgtcaataaatcccaataggtttgtactgttgcgatttccactttttcatctggtgagtgagcatttcggattgttggcccaacagaaatcatttcaatgtttggataatgttcttttaaaagaccacattctaatcctgcgtgaatgactttcactacaggttgctcgcctagcacttcagcataatgtttgcgagtaacgtctaagatagttgagtcatttacaggttgccagcccggataaggtgcagaaaactcgacttttgcatttgctaagattgcaagtgagctgagcatttcagttacgtaatatttaccgctttcaattaatgaacgaactaaaatagtgctttttacaacattaccttctgttttcaatacgccaacgcttaatgaactttctacaacatttttaactacatcactattgcggattacgccatttggtaatacgttgagtgcgttaataaccgtttgagtgctttgtgcggtgaatacggtaggggctttttctgcggattctacaaaaagtgtgaaattaggttctgcaattgctaattcttctttaagcacaaccgcgagattttctaccgcactttctatggtttttacatcgccattaaaggctaacacagctgctgcttctcgaggaattgcattacgaattgagccaccacgaatatcagagagagcaaagtgcggttgattttgagaaagttttgctaatactcgcgctaacactttaattgcatttgcacgccctgtatggatatcgccgccagagtggccgccacgtaaacccttaagggtgatttgtgcgctgcgctcaaacgtattggtttcatattgaacgggaatttcaaagtttgcgttaatcccgcccgcacaaccaatgtaaatttcgccaatttcttcggtatctgtattgattaaaatttcagattgtaaccagctatgacgtaagccttttgcgccatccatgcctgtttcttctgtcattgttaaaagcacttcaagaggtggatgggctaaatcattgctttctaacaccgctaaagtagaggctaaaccgataccattgtcagctcctaatgtggtacctcgtgctttcacccattctccatcaatataaggttgaattggatctttggtaaaatcatgtggattgccttcattagcctgtggcaccatatctagatgggcttgtagcacaacaggcgtgtgattttccattcctttcgtcgcgggtttacgaatgagaatattccccacttcatcgcgttcaacaaaaaaatgcttttcttttgcccaatttacaataaagttagctaacgtatcttcataatgagaaggatgagggattgcacaaatttgatcgaaccatttccataacagtgaaggttgaagtgttgtaatttcagacatagttgctcctttttactgaaaatatttacgaaataatagcataaaacgccatttcgggttatccttacgcaattttttatttctcgataaatttaaactaaggtgcaattatgagcgaaaaatatgtggtaacttgggatatgtttcaaatgcatgcccgcagattatcagaacgtttacttccagcttcccaatggaaaggtattattgcggtgagtcgcggtggtttgtttccagcggctgtattggctagagaattgggtcttcgtcatattgaaaccgtttgtatcgcaagttatcacgatcataacaatcaaggtgaactacaagttcttcatgcagcccaagtgccaaatggcggcgaaggatttatcgtggtagatgatttagttgatacgggtaatacggcacgtgcgattcgtcaaatgtaccctaatgcaaaatttgtcactgtatttgcaaaacctgcaggtgcggaattagtggatgattacgtaattgatattccacaaaatacttggattgagcaaccttgggatttaggtttaacctttgttccacctctctctagaaaataatttttatacaaaaaagtgcggttaaaataaaagaatttttaaccgcactttctttcattttatcgtttttcctaatttttcacggtaaacaggttaaaattttactcacaataaatatccgtatgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaataatgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaattatgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaataatttactattcttatattcttaaaagtgcggtgcaatttgaaaagaatttcatcgcatttttattagtgaaataataagcgattgctcgttattattaagtgaccattggtgaaaggagacgcccatttatgggtgagggagcaatggagggcttcagtccgcctttttgcttaccaaccttgttgaatatatggttcattattaattgatggaatttatacgctttaacgagaatattccattaactaaaccatttaataaaacaaatgtaaaacagtgagcttattgccaacttagattttcttattatacatttaaccaaaacgtcacaggcccatcatttgttaagctcacttgcatatccgctgcaaattgccctgttgaaacaggtaatttctctgcgcacttttggataaagtattcatataattcattagccaatgctggggacgcaccttttgaaaaactcgggcgtaaacctttttgcgtatccgctgctaatgtaaattgcgaaacgataagtaattccccctgcgcttgttgaacatttaaattcatcttgtcattttcatcactgaaaattcgataattaagcactttttcagcgagtttatccgctttttctcggttatcttctttttctacaccaagcaaaactaacaaacctttgccaattttccctattgtttcgccctttacattcacttttgcttgagacacacgctgaattagggcgatcatttcaatccctcaataaaactcggtaaccattcttcagcataactttcttgatcatccacgtttaacacgtcaatttttaaagtctcacaaatttttaccgcactttttgcttgaagtgtttgctccactttgtccgctgcatagcaaaaagtatcataatcagaactacctaatccaacgaccgcaaagcgaacatctgaaaaatccttttggctattcgctaattcatcaaataggggttttaaattgtctggcaattcgcctgcaccgtgcgttgaagtgacaatcagccaaattttctcgttttcaatgtcagataaatttggtccgtgaaaaagtgcggtggaaaaaccttgagtttctaaaacatcgtttaaatgctcggcaacatattccgccccacctaaagtgctgcctgaaagaatacaaatgtgcattttattatcctatatttattttcttctcaaagagaaaagaaaattattgaaatgattaataataaaaaggcttagaaaatctaagccttttattacgattaaacgttatcaaacttaccaagtaatgaacgaatatgctcttgccagttacgatgttcgtttttcagctgttcattttcagtttgtaagttttcgatatttctttgagattctgcgtttttctcttttaattcttcaacttctaattgaagtaattggatagtttctaccgcttgtttaattttttcttcaagctggtctaaaatttctaaagacataatgatttccttttaaatatgggtaagtttaggggtattttacccagtaaatttacctttttaaagcattgaataaaaatttattatgcaaacgattactcagtgatagaatgatgctatttttgccataatcttgaaaaataagcagaaggagaataataatgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatttagctcaaacaaacaacatttcaattaatttaatctgctctccaaaaagctgaacaaatgacttactaaacagggagcagattttaaaatgtcatttttaaataattaaatcattttttctcaaaaaaatatcaaaaaagatattctaaaaacaaatatattcatatatgatataaaaaatattttattaaaataaaagtatcaaatatgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaatgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagacaagtacggaaaaataggtgcagataatgagcaatatgtgagttatgaacaaattgctaagtttattttgcagcacactgaaaatcatttagctcagcaacgagaaatttttcgtcgaattatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataaaatccaaagggaattttcaccgcactttttctctccaacaaaaaaatcgcacctttaacagtgcgattttttcttatattaatttaggacattctgccgttttctataccaattacctgatcgcaaatagccatggtagattggcgatggctgacgagaataatcaatttctcagctttagcatcgagtaatgatttcaaaatcattgcttcgtttaagctatccaaattactggttggctcatcaagcaagataatcggtgcattatgcaagaatgctcgggcaataccgatacgttgtttttcaccgtcagagagattgccgcccaattcggtcatttttgtttgataaccttgtggcaaactcaaaataaaatcatgaattgaggctttcttcgccgcttccataatttcttctaaggttgcatcacggcgcgcaaggcgaatattttcttcaatggtttcgttgaaaatataggtttgctgagtaatgtacgccatattgtcacgcaaactgcaagtgttgatattcggtaaggtttcgccgttaattttaatgctacctgattttggatcataaaaacgcatcagcaatttcaataaggtacttttaccgctgccgcttctgccgtgaatacctaaaatttcgccttttttcacagataagctgacatccgataaaatttgttcttcgccgtaagcgaagtttaggttctctacatcaatgcgagaaacatcttttaaatctaccgcactttctacatcttttaactctggctcttccgctaataaacttaatactcgttcgccagaagccaaagtttgtaataagttgcttgaaaggttacttaaggcgataactggcccatagctcgacattaataaaataacgccgattaaaaaggcagcgaaatcaattttatctaagctaaacaaaattaagccagtaaacagcataatgatgttgaaaacagatactgccacttcagtataaacacgaactttcgcttcttggtctttaatgcgttcaaaggcggtatcaattttttggctacgttgttggatttctgctaaacgttgttgtgcatagccaaaaagctgaatttctttcataccacgcacgctgtcaaggaagaaatcattcatttcgccgactaattcacgatagcgtctgccatcttcacgagccaatttggtggtgataatcggtaaaatcacacctaccgttaaataagcggctaatgcgacaactacaaaccaacctgaaagatgggcaaagaccaacaatagaatcgcagaggtaaagaacgcaatcataattggtgcaatggtgtgtgcataaaatacttcgagcaattcaatatcattggttactaatgacactaattgccctgcttgtttatcttgcaacttcacaaaagccaaacgacgcaaagaagaaaacactttgtcacgcaataatgcgagtaatttaaaagcaatataatgcccagacatttgctctaaataacgcaatacaccacgagccaccgctaatacgataagtgcggtcaaaatgccagaaaaacttaaatgggtgtcaaagtttaagagatttactaaccccattgcaccaaacaccataataaagatggcagcaaggaaaccgagcgtccccatagtaatggtaaacgccataatgtgtgcaagtggagtcactaatttcaacaaatgccccattacaacaaaaccatttttacgcatttgccacctctctaatttgttctaaatctttttgttgttggaacatttcagcatacgcaccttgttttgccattaagctttcgtgtgtgccttgctcaatcaatttgccttggtcaagcacattaatacagtccgcattcacagcatttgccaaacggtgagaaatcatcacaatggttttttgttgtttaaattgttgaataaactgcaaaataatttcttcgctttccacatcaatattactggtcgcttcatcaaaaatataaagctcggcattgtgtaacaaagcacgcgctaaagctaaacgttgaatttgaccgcccgataaattcgcacctcggcttaatagctgcatatctaagccgccattttcgcgtacaaattgggcgagattcacttgttctaaacaagcataaatttgttcatctgtggcatcaattttcgccatcgtcatattttcacgcagcgagcctttaaacacataactgctgtggcttactaatgatactttttgatagaaagaagtgcggtcaatattgagggcgttttgtccattaaacaaaatctcaccttgttgcgcttgattaaaacccatcaacaacgaaactaaggtcgatttaccgcaaccacttttacccacaaataccgtaagctgatttggtaaaatactcaaatctaaacctgtaattgctgatttttcttcactataagaaaaatgcagatctttaatttccacttgaacgttattttttgcttcaaaatccaccgcactttgttgggtttccactggcgtatctaacaatgtgaaaatcttatctgaagccgctttgccattcatcgccacatggaagaatgaaccaagcaaacgaagcggaataaagaactcggaggaaagtagaataaataaaatcacgcctaacacgctgagttgtgcattttggaattgcaatagtgcggttaaaatcccgatagctgcgccaccataagcgagtaaatccatcagtgaaaccgagttaagctgcatagtaagcactttcatggtaattttgcggaaatgctcagcctctttatccatcgctttcgctttataaccatcatcttgatagatttttagcgtaattaaaccctgcaagttatctaaaaagctgctgcctaatcccacataaatcgaccaatattttgccaagagttttttcgcaattttattcactgcaatgatcgacatagggataagcggcacacaaatcaacaaaatcacggcagttttaaaactgaaaaaatcaagaaaacaaagagggtaagcggtgcaagcaagctataaaaaagctgcggtaaataacgcccaaagtaaatttcaagctgttctacaccttctgatgccacttgaataatgcttgaggtggattgttgattcacttggttaagcggcatagaagccaatttacgatagataaggctacgcaattcatgcttcacttttgtgctggcaaaataagacgcctgcacagattttttccctgcaaaagcacgcaatgccaatgctgcaatcaaaacgatgcccaaaatgaccgcacttaacaggctcaatttgtgaaaataagccgcctgtaaaatataagaaaacacgacggcactaataatcccgccaactaacgccacccaattccacaacaccgtgacgccaatccattttttgctgtcagccaccgtgttaattaggcgtttatctatcatcataatgattactcctaaaataaaaagaagtacgcatagaaagaattatacgtacttaatgtagggtgggctncnnnaccccnacncnccctcccccccctcccatccagcctttgtcttaagctacccccactgccgccgcgcccccagcctcgcgcgcgcgggctaccctcctcggcgccctcctctcccgcgctcgcccttctgatcattcccccgacctcccgtttcaccctttcccactcgtcctcccgcttccgctccattcccccctatcccccccccttccatgctactccgtccgtctaccgccgtcttcccccctccccgatcccgctcggcgcctcccaccccctacttcccgtcccctgcactctcccccacccaatcctctttcccctcccgcctctcccctcgtccccctctcccgcatcctcctttccccccctgttcctccccccccccctctcccccgtcctgcgtcgcccatccttacacccctcccctcgcccccgaccccccccgcatgctccccccccctctcctcccccctcgtccctcccccgccccctttcccccctcccttcccttcccctttccctcctcccgcccccccttgtcccccccatttccccccccccgcctctttttcccccgcccccttcccccgtaaccccacctcctcccctccccgctcccccgtccccgcctttctctccttcccgccccccctttttcccctctcccttatccccgttccccttccccccgtccgccccctttttcgccttccctccccttctccccccctctcttccccctctttcccgccccctcccccc

SEQ ID NO: 680 - DNA, 85814 bp, H. influenzae
  misc_feature (85747)..(85748): n is a, c, g, or t
  misc_feature (85752)..(85753): n is a, c, g, or t
ttttgatgcgcttgaatttgttacttcgatttttactgtttttctgccgacagtagcgagaatatcgccatcagctaattgtattcgcctgggatcatatctttgttcacggtagggtgtgctttagcccaccaaaataaaaatatcaatggtgggctaaagcccaccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaattataaggtagggcagaatggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattctaaaggactgttttcatagacgaattagtgtaaaaaggcgtgtacgatacgcctcttacttgataaataagaaatcattgtagctgtagtttttctttcgaagagaagaaagtggatttatagaggaaagatgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacattaaaccgctctttaacggatttaggtgcgttgttgcacttggtcgatcccaccttgccgattggtggatttaaccattccaatggcttggaaaccttcgtccagcaacgtgtggtagaaagcaaagcgaccctagaagaatatgtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcgtaagtgcggttattttttattgagattttacttgtaggggcaaatcacatttgcccttgaacattcgttgatatataggggcaaatgtaacttgcccctacacccatgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttccctgatgtggaaatcgtgttcattgaatcaggtggcgataacctttcagcgacttttagccctgatttggcagacgtgacaattttcgtgattgacgtggctcaaggggaaaaaatccctcgtaaaggtgggccgggtatcactcgttcagatttacttgtgatcaacaaaactgatcttgctccattcgttggtgttgacttaagcgtcatggaacgtgatgctcgtcgtatgcgtaacggtcagccgtttattttcactaacctgatgaaaaaagaaaatctggatggcgtgatcggttggatcgaaaaatatgcgtgttgaagaatgtggaagaacctgcatctttggttcgttaatcgtaggggcaaattacatttgcccaattattggtgaaatatcggggctaatgtaattagcccctacaaaatctatgaacagcaaattatccctttccaccaaactttcctccagcggtaaaacccagcttgctgaatactttgcgacgccaccgtttaaagtgataacgttgccaagttacgatgatgcgtgggcgaatggcttgaatgcgatgcagatgtcctcctcccctggggtgctggcgggcgatctgttagagattgatatttcgttggcaaaattgaccgcactttctttaaatacgcaggcatttactcgggtgcaggcgatgaatgaaggcgacagtgcgatgcaaacaacccatattttgcttgcggaaaacagtcgtttattctatttgccgcatccgttggtgttacataaagattccgtttttaagcagcaaacccagattgaaatgggcgaacaaagcgagctgatttacggtgaaatcgtggcgattgggcgggtgttgaatgatgaacgttttgccttccgccagttttcttcccatttgaagatttatactttgaaagacgatggcaaaaaacgaccgcttgtcagtgattgtatccagtggctgccgtctaaaatgaatcttaccgctttgagtcagatggaaaattattcccatcaaggttcgctgacttatctaaatttggcgaaaaataatgcggaaatcaaacaacaggtgcaagccttgcagcaacaaagtacggaagaaaaagatctactgataggcatatcacaactcaatgaatatggtttaatggtgcgggtactcgggtgtcgtgcagagcaaattcagaaattatttgagaaaattggtaggctattgaaatctgtgtaagattgatagatagaacatttttccctaaaaaaactaatccgaaaaatgaaaatatgtcttgagagcattttttgaaaatgtgatcttcatcaagttttttcttcttgaaatttctataatgacgataaattaactaacccaaaaaggtgattaaaatgactcaatttagaaaagaagtagatttacttggcgaacgtgatgtgcctgcagaagcatactgggggattcatacattaagagcggtagaaaatttcaatatttctaacgtaaccatttctgacgtgcctgagtttgtacgtggtatggtaatggtaaaaaaagcaacggctttagccaatggcgaattaggtgcaattccaagtgatattgcaaaagcgattgtagcagcttgtgatgaaatccttaccactggaaaatgcttagatcaattcccatcagatgtatatcaaggtggtgcaggtacgtctgtcaatatgaatactaatgaagtggttgctaatcttgcccttgaaaaaattggtcataaaaaaggcgaatataacgtgattaatccgatggatcacgttaatgcaagccaatcaaccaacgatgcgtatcctactggtttccgtattgcagtgtataacagcatcttaaattgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctgtgcgcaaacaggtaaaggcgtacgtgaagttgtgttagaaaaaggtttattaacagaagaacaattggatgacattctttctgtagaaaacttaatgaatccaacttacaaagcgaaattaaataaataatttacgccaaatatcaagaaaatttaccgcactttaatctgtgccttaaagctgaataaataaaccagctaattgggtgcagatttttttatgattaaaatgttttaaataaccaatatttgttgccattgttaaatgttaatggcttatctaactaaaatagttgaaatttgaatgcatattaatgcggtgctttaagtaaaagtaaaagtaaaaggactaaattctgcggattatagaatttagtccttaaacaaatgtatctgatttttttaagattagatcgatttttctcttttatgtttctctctattcatctaaaaaacttctcagtgtttcagaacggctaggatgacgtaatttacgtaatgcttttgcttcaatttgacgaatacgttcgcgtgttacatcgaattgtttacccacttcttcaagcgtatggtcggtattcatatcaatgccaaaacgcatacgtaatacttttgcttcacgtggcgtcaagccttctagcacttcgtgagttgcaacttttaaactttgtgctgtggcagaatcaagaggaagttctaaggttgaatcttcaataaaatcgcctaaatgtgaatcatcgtcatcgccaataggtgtttccatcgaaatcggctcttttgcaattttcagtactttacggattttatcttctggcattcccatacgttctgccaattcttctggtgttgcttcacgtcccatttcttgtagtaactggcgagaaatacgattaagtttattgattgtttcaatcatatgcacaggaatacggattgtacgcgcttgatccgcaatagagcgagtgattgcttgacgaatccaccaagtagcatatgtagagaatttgtagccacgtcgatattcaaatttatctaccgctttcattaaaccgatattcccttcttgaattaaatctaagaattgtaaacctcgatttgtgtattttttcgcgatggaaattactaaacgcaagttagcttcaaccatttcttttttagctcgacgtgctttttgttcgcctcgtgcgactgcatcgcaaatgtcacgcatttgagtaatggtaagtttagtattttcttctgttatcgctagattgtttaaggcttcataaatacgatcttcatatttaattaaacgtttagcccaaggtttgctagattttaatgcttttgctacccattcactgttactgccattagcggtaataattttttcaaaatcatcctttggcattcctgctatatccactaatattttttgtagctgacgttcttggtagcgcacacgtttcatcatttctttcattgatagaacgagtaaatcaaattgttttggtactaaacggaattgtttaaaaatttcgccaagtagtgcaatttgatcttgggcacgttttccagagcgaccgtgtttttcaataacagcaagggttttagagtgctgttctcttaattgctgaaatttttcgcgagcaacttcaggatcaatactgttatcagagtcgcttgaatctgatgtagattctgattcattgtcttccacatctgcattactagattcttcttcatcatcttcgtcagaaaagtcttcatcaagtccgttgtgttcttctatttcggcatttggatcaacaaaacccgtaattaaatcggtcaaacggaaattacctttttctacatcatcatagttttttagtaatccatttaatgcttcaggataggctgcgatagaggtttgaacttcatcaatccctccttcaatacgttttgcaatgctaatttcatcttcacgagtaagaagatccaccgttcccatttcgcgcatatacatgcgtacgggatccgttgttcgaccgatttcagattctacatttgaaagaatttgagttgcttcttccactgcatcttcatcagggatggtatcactcaacatcatatcatcgctttctggtgcttcatctaatacagggatacctgcatcattttgcaacgtttgtagcaatttgtcgtaatattcaggatcaatagcatcttcgggcaataagtcattgatttcagcaaaagttaaatacccttgtgtacgacctagctccatcaattgctcaatttgttctgaatattgttcagccgtagattgttgatttttttccatttttatactcgttttgcttgatgtgattgagaagataagatttttttatgaacttgagattctaccattgttatagcggattcactaactgttttttctgctgttctttaccagctaaaagatgtacaagtaccgttttttcttcattagtgagaccctctgttcgttctttagcaataagcatttcaatatcgcgctcaatagcttgaatatttaagcgacggtaattttgagaaaatgcgttgattatgtcggattcgtctaataaatgatcccaagttgccagtatttcaaggggattactgtaagatgtattgcggaagtattccaaaatttgccccgtagtaatgccctctcgttggcgacaaagtgcggtcaatttttccagaatttcaaaccctgcttctgcacgtaatgcttgcacgccgctttcagacatacgttttactaactcaggattttgcagaagcaatgaaatgaccattcgcattggtgtcttcttgatcttattatgagtgactttttgttgtgtattggcttgttctaattgtttgggaataagattttccagctgagtttgatcaaaaatcccaagtttttgagcaagcatattgcgtagcgataagcgaagcatttctcctggaatttggtgaattaacggcgcagctagcgcaactaattttccgcgcccttctttagtggaaaaatcaacctgaggacttaaatgtgcaaacataaactcgcttaaagattgcgcactttcgatgtattcttcaaatttttctttgccgtattgacgaatgtaagtatcaggatcttctccatctggcaagaaaataaatttgagttgtctgccatcttctaagtaaggcaacgcattttctagtgctcgccaagcagcatcacgtcctgcacggtcaccatcgtaacaacaaacaacctgttcggtcgaacgaaaaataagttgaatttgttctgatgtcgtggacgtacctaaagaagcgaccgcataatccacgccaaattgtgctaatgccaccacgtccatataaccttcaacaacaagtaattgtttgggttcatcgttggtttgtaaggcttcatacaaaccataaagctccttacctttatgataagtaatggtttctggcgaattcagatatttcggtttttcatctgttaatacacgcccaccaaaagccactgtgcgaccacgtttatcacgaatcggaaacatgatgcgatttcggaatttatcgtaaatattgccacgatcatttcgagaaagcatgcctaattcaatgagtttttgttgttcttcacgattaacaccaaatttacgcagtacagtatccattgcattcggcacaaacccaatttggaaacgctcaataatttcaggtgaaagcccacgttgttgtaaatattcttgtgcttgagtatttaatggtaattggttttgataaaacgtggcaatctcttgcattaattcatagagatttcgtttggtttggtaattagcttgaggttttccgctgtgattagcgcgtttttcgtaaggtatttcaagccctgccattgctgcaagttcttcaatcgcctctataaattcaagtttgtcataatccattaaaaaggaaatcgcattaccatgtgcaccacaaccaaagcaatgataaaactgtttcttttggctaactgtgaaggatggtgttttttcgtgatggaaagggcagcaggcttgataatcgcggccagctttttttagttttacgcgcgtgttaatcacatcgacaatatcggactttgtcagcaaatcatcaataaaggggcgtggaatagaacctttcattgtcgagcctccgtgatcgtggtgtgaaagtgcggtcgtttttggcgtagatttttattgtgcttaaagtaacaaaaccgtgagtccaaaggattcacggtttgtcttaactcgagtcagaaaatactataaattagtataaacgggtattgcgcgcgttttcgcgagcgttgcgttttgcgtgacgttttgcaagtgttgcattttcacgtttacgaattgtagttggtttttcgtaaaattcgcgagcgcgtacttcagctaagattcccgctttttcgcaagagcgtttgaaacgacgtaaagctacgtcaaatgattcgttttcacgtactttaattacaggcataagccaatcacctcaatgagtttaatttaattgcaatttaaaattttatttttgccaaagcacctgtgtgtaaatgacaaatttaataaaggacgcaattctaatctatttttagggaaaaagtaaaggatagaatgccaattaaccttaatatttgtggtttcaactggttaaaaccgcttaaacagggtaaaatcgcgcaacattttaggtaataaattaagaaaatcaatgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatttaggagaaaaaatggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatttaaattagtttttaaacacaacattataaggacaattttatgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcggggtaatatttgatttttccctagagaaaacacttttcttcctctgtttgcaggggagctgccgaaggttgaggggagatatagaaagcccccttccgtccttcgggcatcttcccccacaagtaagggaagttattttctacaatttatccgaatgatgaatcattacaaagcgttcccaaagctgttcttcggtttcttgatgttcaggatcgggcttaatacagttagtgattgggcaaactttttggcaggttggggtgtcgtaatggccgacacattccgtgcaaagtataggatcgatcacataaatctcatcgccaatggaaatggcttcgtttgggcattcaggcaagcacatatcgcagttggtacatttgctagtgatgaataatgccattgtgatccttaatagaaagttgaaagcggcgaattatagccgacaaaaacttgattgacaaaaactaaacaaaatttatgaaaaaacttacttccattctttctcttattgttctcgttatattagcaatttggcaatattttaccgatacaaccaaaactaaacatcaatcatcctcgcccgtaattgagcagacgaagcaaacaaaagtatctgagcctaaatttgaacctaaattcgagcctcaatttgagacaaagcggacggatattgaaaaaagtgcggtaaaaaatccagatgtttttgcaaactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaataaccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataagaatttctttgatctaaatcgttacaacctagcacgaagtaggtataatacgaaaagttttcaattttaattttaacttaacaagaggatagattatgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggtttagagttctctgaaacggcagcagcaacagaaaaagcggtaaatgaagtgaaagatgatgaatctatttttgatattggcgataaatcagcagaacaattggctgaaattatcaaaaatgcaaaaaccgttttgtggaatggcccagttggtgtgtttgagttccctcacttccgtaaagggactgaaatcatttctcacgccattgcaaacagcgatgcattctctattgctggcggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaaccgcacttttcctctataacatattgatggtggcatcaaaaatgccatcatcaatacaaattcttcaaattgtgggcttatcccgctaaacataaaaaggaaacacaagtatggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgttttataatccacaaaaataacataaaatacggccgcactttcaagtgcggtttttttattttagcggagaaattatggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatttaagaagaattgaacaacgctgcctatgctggtggcgaaaaggacagtacccaagccaacgacaccaccaagtaaaaaaccaagtaaacaaaccgagatttcaaggcttgagcgtaccacgttgatgcttaaatgaaaacgttggcaaataccaaccattaatccgtctcgagggcctgcacctaagtgacaagtgagatataacgcagttccaaaaccatagagtaatataccgatcagacagaagatcattcgtgaaaaaagtgcggttggcggcgtcagtatttttgttgtgatccctagaaatagagcaataacgataatatttaataatgtcccaagcccaaggcgtaatttgagaggtttccataccaacattactgcgcaactaattaaaaaagatgaccagccaatatcaaaatttgtctgtattgctataccttgtgaaagtacagtccaaggtgtcgatcctaaacctgataatacaataagcccatctccaatacctaaaatagaaagagcaaaaagtaagattgaaatggttttatattgcgcggtccataatgatgtggcagcccaagatgtgcgaggtataacgcgtacttttttcttcatatttattaccttttatattccgttttatcataaaaggaaagatgcaaaaacagaaataattttgtcagttcatttatatcaaaaacatatttattttgagtaaccgtttgcataatgtttattttctaaaactgtgatcttcctcacgttttcaaaattgtctattttgttaccattgcgtacaatacgaaaccattttcaaaggggacgttatgttagcttcacttcaagatattctcgatacggttaaagccaataatctgacttatcatcaaaaattaatgacattaggcaatattgccgagcgtttatttgatcctcgcgatttacttggctataccgatgaagaatggggctttttacagaatcagatgatttgtgatttatgtgaaggctacgcgatttatcgtcctcgttatatcctgcctgattacaatgtgtatatccaaaagggctgcgaatttttagagttgccgcctccaaaagatcttgatgaggcacttgatggattattgattctttactcccgcgtgccatccattacgacttatcctgtttatgttgggcgtcttgatgtgttgctcgaaccgttcattactgatgaagaaaaagattacataaaaattaaacgtttcttaaatcatattgataaaactgtgcctgactcattctgtcatgccaatattgggccttatgatacgaaagcaggtcgcttgattttacgcgccgtgattgagcttgaagcgccaacaccgaatatgactattcgttatgacaaatcgaaaacaagccgtgattttgctgaacttgcagcaaaagcctgtttgttggtttctaaaccatcttttgccaacgatgcttactatatttccgatctaggcgaagaatacggcgtagcaagttgctataacgcactgcctgaatgtggcggcgcctacaccttaacgcgtttacgtctagggacaattgctcgcacctgtaaaagtgcggatgaaatgctgaatgaattattaccgcgtgtggcgaaatgtgctctttcaaccatggataaacgccacaaatttgtagtggaagaaagtaatttctttaacagttcattcctcgaaaaagagggatttatcaaacgcactaattttacggggatgttcgcaattgtgggcttggcagatgcagcaaaccacttattgcaatgtgaaggcttaaatgaaacctttggtaagagcgttcgtggcgatgaaattgccactgcgattatggataaattgaaagaaattactgatgcgcacgaaggagtttatgccgaacgtactggcaatcgttatttattacacgcacaagtgggcgcaagtaaccacgaagaagacaagcgtaacgcaccggctcaccgtattcgtgtaggcgaagaaccaacgttacttgcacatttgaaacaatctgcaccgttccataaatatttcccatctggtacaggggatttattcgcctttgatcaaacctatgtagatcactgcgatgcagtggtggatattattgatggcgcattttccttaggctatcgctacattaccacctatttgaaaaatacagatttaattcgagttacaggttatctagtgaagaaaagcgaagttgaaaaataccgtaaaggcgaagttgcattacgcgatacaacttggtatggctcgggtacggatgaatgtgccaatgtgtttgatcgccaattacgcaatgaaaaagatgtgatcgctgaaaaataattagaaaaatgaccgcactttctgagatttttgtgccgttgcatcggattattcctttttcaaatgtagagggacaaggcaatcgttcgagtatttttctgcaaggttgcaagctaaattgcttgtattgccataatccggaaaccatacctcgttatacggaaagtgcgaaattggtcagtttgcagtatttgtatgaacaggttatggaggcagttccatttattcgcggtgtaacggtttctggtggagaacccactattcatcacaaaaaacttgtgccactctttaaggctttacgttcgcaaggattgacttgttatttggatagtagtggcttttttgagtttgatcgtgtttgttcgttaattgatgtcactgacaaatttttatttgatctcaaaggcgagggcattggcttgcaaacactttgttttgatcggaaaaatcaagcaggtattgtatcacagcaagtgatactagagcgtttgcatataaaaaacgataaactggagcggaatttgcaaaatttagctgccttattgccattaaataaagtggaagaagtgcggttggtttttttaaagcatttttttgatgctgaacatttggtgggcaaagttgctcaactactacgaaattatcctgatgtggcattaaaaattatctgcgtgcatagcaaaggcgtacgtgatgaagctgggttatcagcgtatatcccaagtgtggaagaaactaatgcgctatctgcttatgcgcgtcaatgtggaattaacaagattttgactattttatagacgtttacaaaaagtgcggtgaaaattcgccgacttttcataagaaaacaagtagaataagccgaattttattaacttaactaatctaggggaatcaaatgagtgtgttaagcagcattttgggaatggtcgtattaatcgctattgccgtgttactttctaataatcgtaaagcgattagtattcgaaccgtagtaggggcgttagcaatccaagtaggatttgccgcccttattttatatgtgccagcaggtaaacaagcgttgggtgccgctgcggatatggtatccaatgttattgcctatggtaatgacgggattaatttcgttttcggcggattggcagatccaagtaaaccatccggtttcatttttgcagtgaaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcgttggtttaattgcattaattaatggtattttaagtggcgtaggcggatggttcggctatggcgacttaaccttacaatctatctttggtttaatttttaaaccattagcatacttaatcggtgtaactgatggtgctgaagcaggtattgcaggacaaatgatcgggatgaaattagcggttaatgaatttgtgggttatcttgaatttgcaaaatatttacaaccagattctgcaattgtattaactgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaatttatcttaatcaattaaaaagtgcggtaaaaaatgaccgcactttattcatttttattcattattaaaaataaggaaaaattatgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcactataatatcttctatcggatttaagaagtgcttgaaaaacaaccgcactttttatataatccgcgcccattatgagccgtttgtggctcatatttttgtgtggtgcaatgaatcttgcactaaaaattatcggggagctatttaatagcgttattacccaattagaggaaaactaaaatggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaataatacgatggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttctttataatttaaagaattgatagattttaaaccgcactttttgaaagtgcggtttttttgtttcataaaatttctatataagttttaaacttgacgagaaagctgcattcatttaaaatttaccgccttaaaattagcaaagatttagattgatttttaatcaatcttgaccttttattgcttaatttaaccgtgtttttgatagaaagcacatccacacaatgacaaattcaccgttatttgtcgttgttttgctcaagttgtcgttctatgtaatttgagttgtcaccccactatagaagtaaggttcagagtgcggtcattttaacggtcattcacgtcacagttagtttgtggctaggtcactgaacagttagcagaggaaaaccaatgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaaatccgatgatgtgaatggtcgtacgaagatgtataaaaatatcgtaagtggcaaccaacatatggagccaggcacaccggaatctttcaacgtaattatgaaagaaatccgctcacttggtttaaatatcgagttagacgaagagtaatttcattcttgccttcccctgcttgtgggggaaggtgcccgaagggcggaagggggaaattcccccctcagcctgcggcagctccccccgtaaacagggggagcgaagagaaaaaatgacgaaacaataaatcgccgaagtgcggtcaaaattctccgaaatttttaaccgcactttaaacctttaactccgacaggagaacatttgtgaaagacttagttaagtttttaaaagcacaatcaaaaaccagtgaagattttgatgtgattaaaattgggttagcttccccagatatgatccgttcttggtcatttggtgaagtgaagaaacctgaaaccattaactaccgtacgttcaaacctgaacgtgatggtcttttctgtgcgcgtatcttcgggcctgtaaaagattacgaatgtttatgtggtaaatataaacgtttaaaacaccgtggtgtgatttgtgaaaaatgtggtgttgaagtcactcaaactaaagttcgtcgtgaacgtatgggtcatattgaacttgcatcgccagttgcacatatttggttcttaaaatcattgccgtctcgtatcggtttacttttagatatgccattgcgcgatatcgaacgtgtactttattttgaaatgtacatcgtgaccgaaccaggtatgacggacttagagcgcggtcaattattaacagaagaacaataccttgacgctgaagatcgctggcaagatgaatttgaagcgaaaatgggtgccgaagcgattcaagatctcttaaaaggtatggatcttgaagctgaatgtgaaaaattacgtgaagaattacaagaaactaactctgaaactaaacgtaaaaaaatcactaaacgcttaaaattattagaagcatttgttcaatctggtaataaaccagaatggatggtgatgacggtattgccagttcttccaccagatttacgcccattagtaccacttgatggcggtcgttttgcgacttcagatctgaacgatttatatcgtcgtgtaatcaaccgtaacaatcgtttaaaacgtttattagatttaattgcgccagatattattgtgcgcaacgaaaaacgtatgttacaagaatctgttgatgccttattagataatggtcgtcgcggtcgtgcaattacgggttctaaccgtcgtccattaaaatcattagcggatatgatcaaaggtaaacaaggtcgtttccgtcaaaatttattaggtaaacgtgttgattactctggtcgttctgtaatcactgttggcccatacttgcacttacaccaatgtggtttaccgaagaaaatggcattggaattattccgtccgtttatctatgcgaaattagaaagccgtggttatgctacgacaatcaaagcggctaagaaaatggttgagcgtgaagaggcgatcgtttgggatattcttgcagaagttattcgtgaacacccaattctattgaaccgtgcgccaacacttcaccgtttgggtatccaagcgtttgaaccgatcttaatcgaaggtaaagcgattcaattacacccactcgtttgtgcggcgtttaacgcagacttcgatggtgaccaaatggcggtacatgttccattaacccttgaagcgcaattagaagctcgtgcgttgatgatgtccaccaataacgtgctttctccagcaaacggtgatcctattatcgttccatcacaagacgtggtattaggtctttactatatgacccgcgaaaaagtgaacggtaaaggcgaaggtatgttattgcaagatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaaggcatgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctggttcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaataattaattccctgtatgagaaaacccgaatgaaagttcgggttttttatttttatgaaaatgggtagaggttttatgccagaacaacaagtatgtttcttcatagaaattcacaaaaatttgagacttttagaaaagtctgttgttgatagttatgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaataaggcatttaaattaactaaggcagggattccctgccttatttacatattacatctatttgtctttttctatttcaatcacttctacacaatttaccgtacccgctttaattcgccatttcacattaaattcgtacaaacttgttccataaatacgatcactcggtttaccttgttgataggctgggcgaggatcttgctctagcacttggcgaataaaacgacttaagtgcggtcgtttttcttctcgtttttttaccgcacttttggcttgctcggtaaattcaacagtcagttttactggtggtttttcttgagcaaagctcgattgtgcatttggctcactatccgcataggcaatatagggtttgatatcgaaaatgggcgtgccatccactaaatccaccgcacctaaatggagaaaaatgttaccgttgatgcattctacttgacgtaattcgactttggataaaccaagaggatttgggcggtgcgttgcgcgtgaagcaaacactccaattcgttgattaccgcctaaccgaggagggcgtacggtgggttgccatttcccttgttggatttggtcgaattgaaaaattaaccaaagatgactgaattgttctaatcctctcacggcttcaggcgaattataaggcggtaagagttctacaatgcctactccgtcttcaactaacttaggttggcgtggtacggagaatttttctttataaggcgtgtggataatggcgataggcgataaggttaaatcattcataaattgggtgtcttagtgtagaatacgcggcttattgtaatcaaaagtgcggtcaaaaaaaatgataaatgaaaaattgaaaatgtggtgggaaacggctcgaccgaaaactttgcccttagcgttggcatcgattttcacgggttcggcattaggttattgggcgaatccacaaggttttaatgggcttgtaatggtgctttgtttactcacgacaattttattgcaggtgctttctaattttgccaatgattatggggatcatcaaaaaggttcagatactgaagaacgtattgggccattacgtggcattcaaaaaggcgcaatttcagcaaaagaactgaaatggggattaattctaatggtgatggcaagttttctttcaggaagtttcttgattggaatcgcttatgaaaatctctcagatttattcgctttcgctgggcttggaattttagctattgttgctgccattacttacactgttggggcaaaaccttatggctatatgggattaggcgatatttctgtattagtattttttggtttgcttggcgttggcggcacttattatttgcaaactcacagtattgctagccacattattttgcctgctattggttctggcttattggcaagtgcggtattaaatatcaataatttacgtgatattgaacaggatgcgaaagctagcaaaaataccctagccgttcgtttaggtgcatataaagggcgtgtttatcattgtattttattaagtgtggcggctctatgttatttggcatttgcggtggcaacggccacggccacttcttggacaaattatttatttgtattagcaatgccattgttagctaaacacgcgatctttgtttatcgtagtcagcagccaagtgaattgcgtccaatgttggctcaaatgtctatgatttcgttattaatcaatatcttgtttagtttaggcttgcttatcggctaaatcggcatatactaaagcaaacaaaatttcaacaatcgataggggaaagttatgtttattgatacttcagaactttgcgatctttatgcagaacaagtggatgtcgtggagccaattttttcaagctttggtggcgtaagtcatttttacggtaaagtcactacagtaaaatgctttgaaagtaatggattaattgctgaagtattagaagaaaacggcgaaggtcgagtgcttgtcattgatggcggtggtgcggtacgccgtggtttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagattaatttctacttgattaacatcttagtattttatttaagctttcctattctaaacggcgtatcatactaaaaaattaaattgtaactatatgatatataaaaccccgttcaatttgaacggggttaaaagtgcggtaaatttttaatgtgttttatggcttgtgctatacaaaattttgtccgtataagctaaagcaattgccgacactaaaaagcccaagtgcaacaataattgccacatcatcgttttttctggcatattgcttgcattcacaaaagtttgcaacatatggatagatgaaatgccgataatagacatagaaagtttaactttcaacacggtggcatttacgtggctcatccattcaggttgatcggggtgattacgtgtacgcaatttagatacaaagatttcatagccaccgatagtcaccatcacaagtaagttggcgatcatcacgacatcaatcaaattcaacacgcctaacataattgtgttggaatccatatcatttacattaatcactaactcccataatcctttgataaatttataagagtagattgcaagggtgacaatcaagcccaaataaatcggcacttgcaaccagcgactagcaaaaattattttcgcgataatattcgattgttcgttatatttcgcataaggatcaacaggtttgttttctttcataagattttattcctaaattaaacagtgggttaaataaacaaaaaaaccgcaagaaaatagcagtttttttgaaaatagcaataaggaaattgagttattctaattttatttgaaactgtaaatagactctcttaacacacaagtcggttctaacaccaaagtgaggtaattttcattaggatttttaattcgttgcaatagtgtttcaacagcgagtttgccaagttcagctttcggttggcaaatggtggagagaggaggcgagagataacgagccaattcaatgtcatcatagcccataattgaaagatcttgcggaatacgtaagccttgttgctgaatagcttggtatgcaccgacagcaatggtgtcactacaacaaaaaactgctgttggacgtgaagattgagtaagtaaagattgtatgccaagtacaccgccttcaaagtcaaaatgactttcgacaatccaatgaggatttaacgcaatttttgcttccgacagcgcatttttataaccttgcaaacgattttgtgcgacagattttttgagatttcccgtaataatgccaattttacgatgtcctgcatcaattaatgcttttgtcgccaaatagccaccaagtgctgaattttcgagtattttatctgcatttaactcagtaaaccaccagtccatcacaaccagtggcagcgaaatggctaactctatatcagcctgaaaacggctatcaccacacatcaaaagcaaaccatccacttgtttgtgcattagagtttgcagattttgttgtaggcgtttggcatctccacccgttgtagcaataataagattatattgatttttctgacaatattgctccacgccagccatcacttccgcaaagaagggattatttgttgcggtgacaagtagcccgatagttttggtttcgcgcaccttaaggcttcgtgcaacagctgaaggggtgtaattcagttcagcgacaatacgcatcactttctcacgaatttcatcgctaacaaaacgcgatccattaatgacatgtgaaactgtagaagtcgaaacttgcgccagtcgtgcaatatctttcattgtcgccataaaaacaccctaaaaattcaccgcactttaagcgtgttcaagaaattccaaagtttcttgacgcgttggaatagaggattgagccccttttttcgtcacactaatcgcagcggcagcttgaccaaaacgaatggcttcatcaaaggatttttcttccaataaagccgtaacaaaaccgccattaaatgtatcaccagctgcggtagtatctattgcttgcacacaaaagcccttaatgatgcggcttttaccttttcgactgacaaacacacctttcgcgccaagggtaatcattacggtttcaatgcctttatcgtgaaaaacactcgcagctttcaccgcactttgctcgtcggctaccgctacccccgtcaggatttcagcttctgtttcatttggtgtaataatatcaatcaaactcaataattcgtccgataaaatctgcgctggagcaggatttagcacaaccttaacaccatttttcttagcgatttgagcagccagctccacaccagaaagtggggtttctaattgcattaacaagcaatccgattgtgcaatttgcgcctcactttgacgaacgaccatctcacccaaatgtgcatttgcaccgctagccaacacaatactgttctcactagacttggcgacttgaataaatgccattcctgtcatttcctgtgaaacggtattaatatgggttgtatcaattccttcttgctcaaacgcatttttcattgttttgcctatgctatctgatccaatgcaactaatgaacgctacctttgcacctaaacgagcggctgccactgcttgattggcacctttgccaccataggcaatttgataattttgacctgttagcgtttcaccgggtttagcaaagtaaggcacagaaataacgtgatcagcattgatactaccgagaaccgtgagggtttttttcattattttatcctgtattgttatattttttctttctacacaatgggacaaatataatttgccccataatgtgatataacgagcttatttagtagatagattattcacttattactttcaaatctactggaattttcgcttcaactttttcgccctttaagattttatcagcggtaacaacacctaatgaaccaataagctcgggttgttgtgcgatagttgctgccattttgccactttttaccgctttaacaccatcatcggtaccatcaaaacctacgataaggacttttttatttgcggctttcaccgcacgtaatgcacctaatgccatttcatcattttgcgcaaaaattgcttgaacatcacctttagatgccaacaaattttccgttacattcaaaccttttgttcgatcaaaatctgctggctgactggcaagcacattgaatttatgagcatcaatagcttgtttgaaaccctcacctcgttcgcgtgccgcagatgttcctgcaataccttcaagttgaatcaccttggcattatcgcctaatttctgtgcgataaaatcacctgccattttaccacctgcgatattgtcagatgcaatatggctcactacgtttcctttagctgcgccacgatctaatgtaattactggaatatgcttacggtttgcaatcgccactgcgttgccaactgcttcagaatcagttggattgatcaataatatttttgcaccacgcacagttaaatcttcgacattagctaattctttagcagggtcattttgtgaatcaagcaccactaacttataacctaattcatccgcttttttctgtgcgccatcttttaacgttacaaaaaatgggttatctaatgtagatactgccaaagcgattgtgtcttgtgcagaagcagagccagaaacagccaaacctaataatacagcagaagtaagtgcggttagttttttcatagtttctccttaaagtgagttacagtttttttgtaccaagatagttatcggctaaaacagcaaccaaaataaccaacgcttttgctatcatttgatagtaagatgaaatatctaataaatttaatgcattgtttaaaaatccgatgattaatgcaccgatgagagttcccattacacgacctttcccccccatcaaactggttccaccgactaccacggcggcaattgcatctaattcataagatacgccagcagtgggttgagcggaagataaacgtgaagttacaattaaacccgccagcgcagaaagaaatccactcaccgcaaaaacaaatactttgattttattgacgttaataccagaaagttgggtcgctgcctcatttccacctaaagcataaatatagcgaccgattggtgtgtgttttaaaatataccaagcaaccgcaaacacgatactcataatccaaattggtactgggatacctaaaacatagcctgtaccaatgctagcaaatagatcagcattatccgaaaaacctgtcgtaataggacgaccatctgtataaaccattgttataccacgcagtaaggtcatggtaaccaaggtagcaataaaagcctgaactttcccttttgccacaattacaccacttatgccaccaagaagtgttccaatcaataaaaccacaggaatgactaaaaaaataggcaattcgatactcaccattgaagcggcgattgcacctgtcaatgccaatacagatccaacagaaagatctatacctgcaattaaaataacgaaagtcatacccactgcaataatcgcattaaccgaagtttggcgtaaaatattcaaaatattatctacgctaaaaaaatcaggattaatcattgatacaatcgcgataagaataatcaacgcaataaaagaacgctgttcaatcaaaaatcttcctatttgaaaattagatgtttcatttttcatcatacttacctactcttatttaccaatagctgctgctaataatttttcttgagttgcgtctttgcgagaaaattctgcactaattttaccttcacgcattaccaacactctatcgctcataccaagcacttctggcatatcagatgagatcattaaaatactcaagccctctttcttaaattcgttaatcaactgataaatttctttcttcgcgccaacatctacgccacgagttggttcatctaaaatcaacacatttgggcgagtcattaatccacgagcaattgccactttttgttgatttccaccagatagcaaacctacttgttgatcacgattaggtgttttaatgttaaacatcagaataaagtcatctactgtcattttttccgcttgatgacgaatactgcctttttgtgaaaaatgatcgagcgatgtgagcgacatattttcttttactgacattcctaaaaccaagccatcacctttacgatcttcagaaatatatacaataccattatccaaaccatcttgcggactgagattctcaatctcttgattttttaaccgcacttttcccgccgtttttggcaaagcaccgtaaagtagcttgccgagttccgttctacccgcacccattaagcccgagacaccaacaatttcaccggcatgcaatttgaaggaaacatcatcaataccgcttccgctcacatttttcacatccaatacacattcgcctttttcttgtgataaatgcggatattgttcatcaagacgacgaccaaccatcatttcaattaaatcatcttctgtaatttctgccacaatgcgttcaccgataaattgaccatcgcgtaaaaccgtcacatcatcacaaatttggaaaatttcttttaaacgatgagagatataaacaatgccacgattttctgctttgagttcacgaatcacattgaatagggcttcggtctccgtatctgtgagcgcatcggttggttcatccataatgataactttggattcaaaacttaaggctttggctatctccaccatttgttgctcaccaatagaaagttcagcgcaaagctgtttactgctgtgagttacccccaaacgcgcaagtagcttgtctgcttcttggtgcattttctgccagttaatcgctccccacgaggttttaaattcacgaccaaggaaaatgttttctgcaatcgtgagattaccgaccaaattcagttcttggtgaataatactaatgccagcttcctgtgaggctttaggtccattgaaattaactgatcgattaagatactcaattgtgcctgcatctttagaataaataccagtaagcaccttcatcaaagtcgatttacccgccccattttcccccatcaatgccattacgcgtccagcgtaaacagataaacaggcattattcaaggctttcacacctggaaatgacttatcaacaccactaattttgagtaaagtttccataatttcaccctgattaaaatggcacgccagaatataaaatcacattggcataaggtgaacattcgccagtacgaacaatagctttactttcgagggtgaattttttaaaagtttcgtgcgatacaaattccacttgtatttgattaccctgatggctttcaagttgttgaagttgtgttaaaagtgcggtcaatatttctggatttttttctttaatttcttctgcaataacaacgcgttcaacatacatttcattcgttactacattcaacgtttgtagaaaacttggtacacccgcagttaatgcgagatcgatacgttccacacttaacggaattggaagtcccgcatcgcaaatcgtcaaactttctgtgtgaccaacagaagcgatacaacgagaaagttgtgcatttaataacattgtttttttcatatatttcctctttccacctttatcgaaacgtttcgataagataaatataaagaacaaaaatagaaaaacaactaagaaatttcaaatttgggatattgatcacaaaatttctagataggataaaaaattctccgaccaaatttacattcaatcggagaataaattattgaagattttcttgatttaagacattcaatctagccaaatccagctgattattcaataagtccacatcgggcattgttttattggcttttgcggaaagggttttaaatcgttctactttgccaactaaaccttgttggccaacaagtgcggtgacggtgctgttgtattggttgctgacagtggaaagcgtattgccgagtttacttaaacgttctgccaccaagcaaatttggttatagatttcgcccgctttttcagcaatttctttggcttcagcattaccacgttcgatacgccagaggtttgccacggtgcgtaaaatcggcattagcgtagtgtgagaaaccataattacattgcgttcataaccgtaattaaataaggcaggatcagcttttaaagcctcaatatacgcaggttccaccgcaataaacataagaacaaaattcggactacgcatgccaatcagattgctgtaatcttttttatgcagatcgttaatatgggtttttaatgcggaaatatgctctttgagtaaacgctctcgttcaaaatcatcctcagaattcaccgcactttcgtaagccacgagcgacattttgctgtcgataattaagtgtttttcatcaggtaaattcaacacaaaatcagggtaattacgcccgccttgttcatctttaaaatgagcttgagcacggtaatgtacattttcttcaagtcctgccagttgcaatgctcgttctaattgcacttcgccccagttgcctaacgttttcttttcgcctttcagcgcagaagttaaattactcgcctcttgcgacatattcagaccaatttccagcacttttttaatttccgcttccaatccagcattgcctttcacggattcggagtgaatttcattgacccgtttttggaaaccttcaatttgctcacggaaaggcttgagcaaggtttccaatgccgtttgatttgattgactaaatgatcgacttttttcatccaaaatacgatttgctaggttttgaaattccacactcaactgcagcttagattgttcaaagttctgttgttgtgcggaaaaatatttttctttctctgttaaggttgtttgtaaccccgttaattcttgagaaagtgcggtcaatttttcagtcaaattttgtcgttcttgtgtgagatgatgtatttgttcatcacgttcagttaaacgatattgcagtccttgattttcagtctgtactttaattgtttgttgttcaaactggtttttaatgctactcagttcatcaaatttactggcaagctgattataatcttgagtcgttttcgataattcttgatgaagatgtgtatatttttgctggcgtagaataagtaataaaatcaatataataacaacagctaacaagctgaaaagtaacaaattttctgacatatttctctcttaatggaaaacacaaattgtagcaaaaaatattattttaattctgctttaaagtgcggtaaattttttaactgatttagaatttatatccatacaaaatttaattattttagtcaattttgatggcaatgctttagaaaaacattgttgtattttaacggtatttatctaaaaacttgtaataccgcacaccaatctttgtcgcaagatctttgataattcgaccaccataaacagaagggactttcagtccttcaaaaatagataaacgttcatcgtcacccaaaatcgcctccgctacaattcgccccgcaagaccagtcaaagcaacaccgtgaccagaataaccatgagcaaaataaatatgcggagaaatacgaccaaaatgtggcgttgagtttaaggtcatatcaatcgggccagcccagccataatcgatttttacattttcaagttgcgggaatacacacaacatatttttccgcataatcgcgaccatatctttttctgagctagaatcactaccaaaaagcaagcgattgtcagcacttaaacgataatagtctaataataaattgttatcacacaccgacatgccattattaatgacagaatcagcaaccgcttggcttaacggctctgtggcgataataaaactttccacaggtaatattttacgattaatgccgtgatgaatagatttcgggagcgcatcaatataagcattggtggctaaaataacgtcttgagaaataaccgcacttttagctgttttaacctcaatgcaaccatttttctcaaccatatccacgacaggagattgttcaaaaatctgaacacccagatcgacacaagctttcgctaaacctaagcaataattaagtggatgcaaatgccctgaattactatcaaatagcccccccacataaatatcactgcctaagtgctgttttaatttagttttatcccaaagttgcatattctgatagccaaaatttttatgactttctttttccatttcaattaagtcatccattcggcgttcatttaatgctaatgtggcatagccttttttccagtcgcattgaatgctatatttttcaatacgttcatcaataatatcaatggtctctaatgacatattccaaagtttatgtgctttatcttcgccaacttgtttaacgtattcatcaatgccttcttcaaagccattaattgcctgcccaccactgcgaccagaagcaccaaagcctactcttgcaccctctaagacaatgactttttttcctttctccgccagttctaatgctgcagataaaccaaaaaatccagccccgatcacacatacatcagcatgttcaatttgagtgagcggcgggaattgaaaatcttggttacgagagtcgaaataataagagcgaacgtgttcttgataggcaaaattaagcataaaaaatcccttaggaaaaaactggcaaaatcttaccccgaaagggaaatatgtcaaaccttttagaaaaaatgctatactgcgcgcacgcaaaatttgcgtgttttatgatgaacgataaccctcggaggtcaataaattgaaaaaattctttgctcactcactcaaaaatcttttcctttccaccaccgcactttttgcggcttccgcttttgccaataacaaactttacgtctataactggacagactatgtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttatttagcgcagaaagaaaatcaatctcttcaatttgtgtatccaaaagaaggcgcaattttctggatggataattatgctattccgaattccgctcaaaacgtggaaggggcgtataagttcatcgactttttacttcgccctgaaaatgcaaaaattgttatcgaacgcatgggcttttctatgccaaataatggggcgaaaacattgctaagcgcggaagttgctaatgatccaaaattatttccaccagcggaagaagtagaaaaaggaattatgcaaggcgatgtaggagaagctgttgatatttatgaaaaatattggagtaaattaaaaactaattagtttctcaatttagaaaacaaaaaagtgcggtaaaaatttaccgcacttttatatgtaaaatttttatctttaaagaataaaacggctcaaatcttcattttcaaccacttcgccaagtgcatccgcaacataagccgcatcaatattgaccgtttgaccattcatatcgcttgcgctgaaagaaattttatccatcaaacgttccattaccgtatgtaaacgacgtgcaccgatattttccgttttttcattcactcggaatgcagcctcagcaattttcttaaccgcctctgttgtaaattcaatattcaccccttctgttgccatcaaggctttatattgttcggttaaagaggcgtgaggttctgttaaaatgcgctcgaaatccgccgcacttaatgcggtaagttcaacacgaatcggcaaacgcccttgtagttcagggattaaatctgaaggacgagcaacttggaatgcaccagatgcaataaataagatatgatcagttttaaccattccgtgcttggtgctaactgtcgagccttccactaacggaagtaaatcacgttgcacaccttcacgcgatacatcagcaccactgtattcacctttcttacaaattttgtcgatttcatcgataaagacgataccattttgttccacagcatcaatggctttttgtttaagttcttcagggttaattaatttcgctgcttcatcatcaatcaacgttttcaacgcatctttaattttcattttgcgttttttcgttttgtctgaacccaaattttggaacaatgattgcagttgatttgtcatttcttccatgcctggaggagccataatttcaacccccatagacacgccagcagacacatcaatttcgatttctttatcatctaattgaccttcacgtaattttttacggaacgcttggcgagtactgctgtgactatcatggttttcaacttcgccccactgattttttgctggaggaagtaaagcatccaaaatacgctcttcagccgcgtcttcagctcttgctctgttcttcgcaatttcttgttggcgaacaagtttcatcgcactatccgttaaatcacgaataatggaatccacctctttccccacgtaacccacttcggtaaatttcgttgcttccactttgataaatggcgcattagctaattttgctaaacggcgcgcaatttcagttttacccacaccagttgggccaatcatcaggatattttttggggttacttcgtgacgcagaggttcttgaagctgcatacgacgccaacggttacgcaacgcaatcgccacagcacgttttgcatcggcttgaccaataatatgttgatctaattcagaaactatttcgcgaggagtcatttcagacatagctttttccttaattcggtaattcttcaatagtgaaattggtatttgtgaacacgcaaacatcacccgcaattttcaaagatttttcaacaatttcacgagcagaaagttcggtgttttccaccaacgcacgtgctgcagacaacgcatagttaccacccgatccgattgctaaaatttgatcttcttcgggctgaaccacatcgccaatacccgtgatgattaaactttctttttcatccgccacaattaacatcgcttctaacttacgaagtgcacgatctgtacgccaatctttcgctaattccaccgcactttttagcaaatgcccttgatgcatttcaagtttacgttcaaataattcaaaaagtgtaaatgcatctgccgttccacccgcaaaaccagcaagtaccttaccattatataaacggcgtactttacgagcattacctttcattacggtattgcctaaagaaacttgtccatcaccgcctacgacgacttgcccattgcgacgtacgcttacaatcgttgtcattgttctgtcctttataaagtgaaaagttgttcgttatatggcgacaaattgattaaattcaagagggaaatttatattgtagatttattcttcactcataaataaaaaatgtgaagttgatcatattttgagatggcaaacgattgccaattattgaatataagctaaaaaaatgtatgatctgagcggtttttaaatcaacgtttgtgaggaaaggcaatgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcaaactctacttatcaaccaatgccaactttaggcggctatggcgaagaagtgttaatcaattcaagctattaattgaccgcaagttgggatttatcttcccccaaaaagttagattgatttagttcaaggactgagttctgtcattcacagggctcagcccttttagtttccctgaatgtgatcatggttgtaataatgaatatactcatgagttgttttttcagttgtttgaacgtctcaaatcgtttgtcgtaataacattcagtttttaatcgtccaaagaagttttccatcgcattgttatctaaataatttcctttccttgacatattctgctgaatgctattctctcgtaaaatcgcctgataaccgaccatttgatacagccaaccttggtcggaatgtaaaattgggttttgcgtcttcaagtcttttttgttggttgagttcttgcaacttttttagaattgcgttctccgcacgtagtaaattttccaattctagttcttcccctcatgttttcggtttaggtggcatcttagggtatttcggtttcatgattggacgacttttaggtttgaggattaagccgtttataccttgtttttcaaaggcttgcagccattgattaacaacgcctgaattggtaatgccaaaatgtaaatatgcggcttctgcagaaaattgcccatttttaaccgcttgtattatgttaagtttaaattcaggtaagtaattttgcttcttactaagtacggataatctattgatttaactatgattaattggttaatccaacgttttagtgttatttaggcaagttgaaaatacctgcgggtaagtgaacgatttttaccattttgaagatcaaattcgatgacttgttgtttgaaaagagtgttgtatttggtcataaaaaatctacaccttagttggttatttagtcaatttttggggtgtagatcataaaatgcgttttttactactaacttttttaggttaatcaagcgtcttcctattttaataaggaattatcgagtgacaaatcttcatttttatttacacctataccgcgtgcgataacatttttggcaatttcgtgtgcatcttctaaggaatgttccgtatagcttccgcattgatagatatttaattcgggaatagaagcttgatcttgtacacctaaaacatcttgcattgaagctaaccaagcctcagacacttcctgttcatttggtgtgccaatcaaagacatataaaatcccgtgcgacatcccatcggagaaatatcaataatttctatgctatcgccatttaaatgatcgcgcataaatccagcaaataaatgttcaagtgtatgaatgccttttggggaaagaatttctttgtttggaatacaaaaacgtaaatcaaaaacagtaatattatcgccttttggcgtgcacatcgtttttgcaatgcgtactgcaggtgcgttcatttttgtgtgatccactttaaaactatcaagtaatggcataaattttccttataaatcagttggttaagaaataattgaataaatatttattttttacaaattttaatgaactttatagtaaggttcattgtcttatagaacaagcaacttgcagttgttttaataaaattggttccttaggttatttgccccacatttattgtggggttttttcttgctcattttataataagaatggtgtactcaaaaacaataacgcaacataacgaaccatttttcccagaaagataaagagactactcgttacaaaatttaatcttaaccaaccagctatggcacaaaataaatcgccaactacaggcagccagctcaaaagtaaaacaatcgccccataacgccgtagctgatttattgcccataaagtgcggtaatttttgggatcgaattttggcatccatcgtccaattccgtaagtggttaaacttcctaagctatttccagcggttgcaatcaatattagagctaatatatctgcgttaaataaagaacctaacattaatttaggtacagcaagcgcaacaaatataacttctgaattacctggtaatactgttgcactcaaaaacgcgctgataaacataaagcataagctattagcctgccaaaaatcagcactaaaaaatgaaaaaatatccattatcttggcgaaataatttctcgtgtgcgaacatcaaacacatccattcccgcacttaatcctgcttgcacgcctaaatccgcatcttcaaatacgatacaacgacttggatttgcttgaattaactccgcacagcgtaaaaaagtttctggatgtggtttatgttcttttacatcatctgcactgacaatggcattaaagtaaggtgcgatagccagtttatccatcaacatatcaataattttacggtgtgagccagaacctaaagcaatcggctttttctgatggaaggatttaacaatttcaaaggttggcaataactttgattgggtcggaataagttgataagacaactcacgttttgcagccagcacatcctcaattcgatctagtggcatattcgccgctttcatcatttcccccgcgatagttcgaaccgtcgccccgccgaagttatacataatttgaaaatcaaattcatagccaaatttctttcccaccattgtccaagcctgcgcatgcacgggcattgtatcaattaaagttccatccatatcaaaaatcaatccttcatatggattgaagatctcgtaatctaacatttttacatccttacaaatttttttaccattttgctacaaaactgtgatctatgcactgttttatttcagtaaagtgcggtaaattagcgaacaaattttgaactaacaaaaacaaatgcggttatttaagcaactagaacgttggaaaactcgcaggcaaataaatcaatctattattgatgtggtatttcgtttacgagatcgattagctcattactggcaagctgatgtgaatacgcctcaagtggattttatgctgctacacattgcttgcagcttaggtcggatagaacgaggaggttgtgtttcttcgctttattcagaaatgctcgaagaaatgcaaagtgcggtcatttttccacaagttttagctattcatcaagatttactcaagttaatgccattttccattcctgaagcagaacaaacttattttttagcgaacattcattctttggttcttgaacagaagcaattaaagcctttgaaatgaattatgcggaggtgcattcaatttatggtgtaaaactggacattgattcggtaaataattcatcaaattactaaaaacattaaggaaatttaccgcacttttaagtaaaatagcgtaatttttcaaagagataataaatatgaaagccaaattagtcagtttacttgcgcaagcaaatataaaaataagtgatcaacaaattcagcagttgattaatctggtcaatttactcaataaatggaataaagcttataatttgacgtcagttcgtgatccgcaagaaatgttagttaaacatattttagatagtcttgttgtaagtccttatttacaaggtgatcgttttattgatgtcggtacagggcctggtttgcctggtttacctttggcaattattaatccttccaaacaatttgtcctccttgatagcttaggtaagcgtattagttttattcgaaatgctatacgtgagcttagactaactaatgtaacccccgttttaagtcgagtagaagaatatcaacctgaagataaatttgatggtgtattaagccgtgcttttgcttcactaaaagatatgacagattggtgccatcatttaccaaaagaaaatggatatttttatgcattaaaagggatttatcaggaagatgaaattaatgaattgaataaaaaatatactattcaaaaagtgattgaattatctgttcctgaacttataggcgaacgacatttaatcgttttacgttaaaaagtaacaaatagataaattattttctaaaagtgtgatttatataacactttttatgtgtttttaagttgaatctaaagccagcaaaggtataatcggcgggctaaaattattttgtaaaagtgatgtcgcgcattttatctcacgctaaaaaaaactacagaaaagctattattattgagagtcttttgcttgtagttttttatttgcttatttatggatggcaacgccaaagtgcggtagattttagctacggttttttaagtgcctttttgcctttttgtacatttatatttatcattttttacagaaaacaaaatttttcaacaaaactgaccgcactttatcgtgctgaagcaataaagtttattttaacgatggtttttatcattattgccatcaaatggttattcgttatcaattttattgcgttttttgttggttttttattggcattagtgctgaataatattattccacttattctcaataaaatttaactttgggttattcttcttcagaacaaaggatcgattatgtctggacaaacaacatcggaatacattagccaccatttatcctttctcaaaacaggggatggattttggaatgttcatatagatacgttgttcttttctattcttgctgcggttattttcctatttgttttttctcgagtagggaaaaaagcaacaactggcgttccaggaaaaatgcaatgcttagttgaaattgttgtggaatgggttaatggaatcgtgaaagaaaattttcatggtccacgtaacgtagttgcgccacttgcattaacaattttctgttgggtattcatcatgaatgctatcgacttaattcctgttgatttcttacctcaatttgcaggtttgttcggtattcattatcttcgtgcagtgccgacagcagatattagcgcaactttgggtatgtccatttgtgttttctttttaattcttttttatacaataaaatctaaaggattcaaaggtttagttaaagaatatacgcttcatccattcaatcattgggcgtttattcctgttaattttattcttgaaacggtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcattaatcgttttttattaaccagctctagggctaaaacttaacttctattggagaaaattatggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaactaatcaccttatttgcttatcaacgtaaaacaagcatagtaaggaggacgttgtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagttataagaggcttagcttatgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatggaaaaaagattagctcgcaaagtgaaattaaattgcaacgtggataacgcacttattgctggtgtgattgttcgtactgaagactttgtgattgacggaagtagccgtgggcaacttactcgtctcgcaaacgagttgcaattataagaggaatacaagatgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttggtagtaacggagagataagatggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatttaagaaaagaggaacggtaatgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaaagtagaaaacacaaataacccaattcaagtaccagtaggcacaaaaacacttggtcgtattatgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatgtaatcacttcaagtcatttgaaggagaacaaaatggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaaccaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacgataattgaaagtataatatagatgaagtgaacttcatttagtttaagggctaagttctataattttagaacttagcctttttgttgtatgagattaatgataagttttgtctgaaatttttatctaaattaattaggataatatttactcttttttagataaaaagtgcggtaaatttttagtttgtttttaacctacaacaaagggtaaataacccgcacgaatcgcaaatggaatggatgtaatgatcacgcctaataccaatacgataattaaagtcagatttcctccccacactttgtatggcaaattagcgtgggcacgacgagctttccaaacaaggctaactggcaatactacggcgtagaatgcaaacatttgacctgcgtagcctagtgctaaaataaaaccttctgggtaaaataatgcaaaaacaagtggtggaataaaagtcagtaaaccaagtgaaattctgcctgctgtaacgttaaatgaacgttttagtaaatcttcaatacattctaacaatcctaatcccacacctaagaaagaagtgataagtgctaatgtagaaaataattttaccgcacttgcgatcacattgcttccagtgatggcgaaggttgcttttactaagccatttaaagtcgcatcttcttttaagatttgtaaaaattcattttgtgtaagcaagccgtgcgtggatagttgccatagaatataagcacaaagtgttatggcagagccgaccaaaatagagaagcgcaatgcttttacattgccatctaagtatttatttaaacttggaatggaaccgtggaaaccaaacgccgtgaaaaatacagggcttgcagagataattaaagccttatcaattggcgtcgccattaagttatcaaatttgatttctggcaacattaagcttaacaccacggcaaaggcagcaagcataacgaaaaataacacgcgattaattttatctacgctatgtgtgccgatgacaataaatgaaccgaaaatcacggtaaataataagacgctaactttatcgccaaaactttctggtaataaatcttttagtagtgaaccgccaccgctgatataagcggcaattaatgcgtataagaaaataattagcacggctgtggcaataatgcgtcctgttttaccaaaatattgttctgcaagtgtgccgatacctgcatcactttccgcagtttgatagagttcaacgaataaaagtgcgctaaaagttaataatgcccaaagccccaataacaagactaaagtaaagccgaagccaatgccagcggaagtgagtggcatagccaacattcccgcgccaatcatcgtaccagcaacaagaagtgtgctgcctacagttttgttcatttttgtttccttatgatgtaataaaaaatttacgataattgtattgtataatttacagtctgtaaataaaatttataaattgtgaattttttactatcttccttgctatattgttgcttaagaagaaggaataaaatgatatttcctaaattttgttgtttatcaatacatttaattaccatagtttcactgtattttacgatgatattgaattgcccaaacaaatcttctaattgctcacttaatattgcctgacaattttcttatttatttcctccttctggatgtaatccaatcccttgatggcgttcttgtagttttgcgataatttcgtaccactgaagatcttgattgtgtaataatacggttaagtgatagaccaaatctgtagcttcagaaatgacttccgctttatcttgtgcgaccgcagccaaggcagtttccacaccttcttcccccactttttgggcgatttttttggtaccttttgcgtgtaatgttgcagtataagaattagaaggatctgcatttttcttttcttttaaatgttgttctaattttataaaccacgcccaatttgcaaattgttgcttcttgttctctgattgtggagaggtaaattgatggaagcagctgtattcacctgtgtggcaagttgccccaatgggatcaactaaaatgagcaaagtgtcgttatcgcaatctaagctcatttcttccacatttaaaaaattgcccgagatttctccttttgtccataatcgttgtttggtacgagagaagaaagttactttacgttctttgatggtttttgtaagggcttcttcattcatatagccaagcattagtacctcacgagtacttatattttgaataataacaggaagaagaccattaactttttgccagtctattttagtaatattcattattcactccgaatctcgatggctgattgcacaaggtaggattttaactcgccaatttcaataatctgtttatggaatacgctggcagctaatgccccatctacttttgcttcaataaaagcatcacgaaaatgtaccattttacccgcaccgccagatgcaattagaggtactctacatactcctcgcaccagcttgagctgggctaaatcgtacccgtttcgtaaaccatcttgattcatcatatttagcacgatttctcctgcaccgcattgttgtacttcttttacccaatctaacaactgccaatgagtttgtcgggtacgtgtttcatcgcctgtatattggtttacccaatacttacctgtttcctgttcaaaccaactatcaatacctactacaatcgcttgtacgccaaaacgatctgctaagcgagaaatgagcgttggatcagcgagagcaggggaattaatcgaaattttatccgccccaaatgcaaacaatttttccgcatcttcaatggttttaatcccacctgctacgcaaaacggaatatcaattacctgagcgattcgttctacccaacttttatccacggtacgaccgtctgatgaagccgtaatatcataaaataccaattcatcagctccttcttgcgcatagcgttgagcaagtggcacaatatcgccaataatttcgtggttacggaattgtaccccttttaccacctgtccatcacgtacatccaaacaaggaattatccgttttgccaacatttgattgcctccgaaagcgtaaattttccttctaataaagcgcgacctacaattacacctgacacacctgtgccttttagagcctcaatatcagccagtgaaccaatccctccagaagattgaaactgaataggtggatatttctcacaaatttcttgataaagtccaatatttgaacctgtcaaggtgccatcgcgtgaaatatcggtacataaaacttgttgtaagccaacggtttggaaatcttcgatcaacgtttctaatagtacaccactttcttcctgccaaccgctaatcgcaacgattttctgaccgcttgcattaatattcacgtctaatgctagaacaaatttttccgcaccatatttgatgaaccagtttttcaccattgaacgatgagttacggcggttgaaccaatcaccacgcgattcgcacccacagccaataaatctgccacatcttgctctgtacgaatgcctcctcccacttgtactttacattgtgttgcttcaacgatttttccaataagtgcggtttgtcttgactggggatttttcgctcccgttaaatcgactagatgtagttgttttgctccttgacgtacataattatcaaattgcttaattggattgtcagaataggtagtttgcttggcataatcgccttggtgtaaccgcacaacttgaccattgataagatcaagagcagggataataatagattgtttcattgtgtttgatcctgtatgactatatgatctagtgattaaaacggtactttttccacaaaattttttagcaacaacgcaccatttttacccgaacgttcgggatgaaattgtacaccgtaaaaattctctttcgctatcgcagcagaaaaattcacaccataattgcttattgccaccgaatgttcattcgggctaactgcataactatgcacaaaatagaagtgactattttgcacaataccatcaaataacggacagttttttacaaattgcacgcgattccatcccatttgaggtaacggtaaacccgtatcgggaattcgattagtttttccgcttattaggtttaaggtcggcacattaccctcttcggaaaattcggtcattaactgcatacccaaacaaattcctagcactggttgagttagattttgaatggtttcgatcaattgacgttcttgtaaattatacattgctgcatttgcagtgcctacgccaggtaaaatcagcttatcggcagatttgattttattgagatcaaaagtgatctcggtattgtaacctaatcggtcaaaggcgaattttacagaagaaaggttggcacaacctgtgtctataatcgtgatgtttgtcatttttttatccttttacaatcggtcgaattttgcaaaaatacgacaaaaattaaccgctctttcaactataaaactccttttgaacttggcatttcatttccttcaatccgaatcgcctgtcttaatgttctcccaaaggctttaaataagctctctattttatgatgatcgttattacccgtgacatttaaatgaatcgtggcaagcattgaaaatgccaaagattgaaagaaatgttcagtgagttccgtactaaaatcgcccactttatcgcgtttaaagcaggcattgaatttgatccaaggtctgcccgataaatctaaagcacattctgctttacattcgtccattggaagcacaaagccgaaacgggcaataccacgtttgtcaccaatggcttgtttcagtgcttgtccaagggcgagagcggtgtcctccaccgtgtgatgttcgtcaatccataaatcgcctttacactgcacgttcattctaaacccaccgtgtgtggcgatttgatcgagcatatggtcaaaaaaaccaacgccagttttgatttcatttacaccagcttcatctagccaaatctgcactttaatatcggtctctttagtttgacgaattacttctgcaaaacgtggcggacgtttgccacagtttgtgaccgtttcccccaacaatttttctgcaatcagatcccaattcattttctgtggatcgtattgaatagctcgaatacctagattttctgctaattgcacatcggtctctcggtcaccaatgacaaaagagcggtcaatatcgaataaatttttacgaatatagtgatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgtaaatgcaatgtcttattctggtctcttaaaataattccttgttcccacaatgccttaaacacagcttgcccgttttgacatttgatcaacagataattagcttcactttcatacactttttccacttgatgtaaaactaaaagagctttagcaagccattgacgattggaaagaagttcttgtgtgagagcttgaacagtggcgatgttcgcaggtcttaacgcttgttccgcaagatcagcactcggcacagggataggatatggagcgattaccttacttaagatgtcaattagctcagggtttgctaacacaaaaccacaacgcaatccagctaaagcaaaggctttagagagcgtgcggataattgctaagtgcgggtaatttttaagcaaattaataacgcttgcttcaggacagaactcaatataggcttcgtccaccaccacaatcgctttgcctgccgtgatttgcaaaagatcgagtatatctgattgcttgagcaaattacctgtcggattatttgggctgcatacaaagactacttttacatcattaagatgatttttgatttctggcaaattaagctgaaaatcgtcagttaaaggcacgctcttacttagcacacctgccgtttcagcactcactgcatacattccgtaagtcggaggacagaataaaatggcatcttgtttgggttcgcaaaaagtgtggattatcaattcaatgccttcatcaccgccacgagtaacgagtacattttcagttgaaacgcccgcataattcgcataagcctgtaccactctttgaggctgaggttcggggtagcggtttaaatccttacccgaaagctgaaattcaggcgaggttggatattcatttgcattcagccaaatcgtaccattgccgccgagttttcgagcggattgatatggcgttaaggcttgtatattttgtcgggataaagttgtgattgtcattattgttttcttccattgtaaaatgtgcgaattgtaatcattcatacatatttcgtattgttgtatgaaaatttgactgcttacgtgtcgtgcttagatctacaattaatatcttagatattgagtttcgccaatcttacacttactgccattttatgtgctgccaattgctcagcttctgccatcacttccaccgtttcagcaaggtttttaaaaccttttggtgtgagttcttgtactgtcattcgcttactaaaatcagctaatcctagactagaataagttttggtgtaaccataagtaggcaaaacgtggtttgtgccactggcataatcgcccatactttcaggcgaatatgcacctaagaaaattgagcctgcgttatctaaatatggtaataatttacgggcgttttttgtttgcacaattaaatgttcaggggcatattcattgctaatttctaccgcttgttcaaggctttctgctataaaaatacggctgtggtttaacgcttttcgagcggtttcagcacgaggtaatagagcaagttggcgttcaatcgcaagtgcggtctcttttgccagagtttcacaggtcgccaccaaaatcacttggctatctgccccatgttccgcttgagagagtaaatcgcttgccacaaattcaggatctgccgattcatctgcaattactaacacttctgaaggtcccgctggcatatcaatcgccgtactattttgtgctacctgacgttttgcttctgtcacaaatgcgtttccaggtccgaaaattttatctactttcgccacactttccgtgccttgagccatcgcaaaaactgcttgagcaccacctatagcgtagatagtttccacaccgcaaagatgagcagtgtagagaatttcatctgagatcggtggcggtgaacaaagcacgatttttttacaacctgcaattttagcaggaatagctaacatcaatacggtggaaaacagcggtgctgaaccacccggaatataaagccctacacaagaaattggacgagtcacaacttggcaacgcacgccttcttggatctctaggtcaatttcctgattttgctgtgctttgtgaaaggcttcaatgttcgttttggcttgctcaatcgcattgcgaagttttacagaaatccgactgcttgccgcttgaatttcatctgccgaaacaatgagtttatctaacttcacgccatcaaatttttcacagagttcaaataacgcccgatcgccattgtatgccacattttcacgaatggcattaactgcctgctgaatgttttccccattttgttggactggacgcataatgactttgcgtttttcagtttctgataaatgattccaaataattgtttgcattgtttattttcctttgtatccgtaaaatggatgataacccaccattttgagatattgattatttaaatggcgagtcaaagctcgcactacatttactccatcatcttctcaattggtaacactaaaattgaactagctcctgcctcttttaactgttccattgtttcccaaaataaattttcttggctcactacgtgcattgctacccgagttgtatcactggctaatggtaaaatggtcggattttcaacgccaggtaaaagcgcagtgattttttcaagtttttctttcggagcgtggagcataatatatttactttctgctgcctgctgtacaccttgaatacgagtgagtagtttatccacaagagcttgtttagttgattcaagcggttcagcacgctgaattaaacaagctttagaacgataaatcacgtccacttcttttaagccatttgcttcaagcgttgcccctgatgatactaaatcgcaaatcgcataagcaatacccgcactaggtgcgacttctactgaaccatttaataaacaacttttaaacgacaccccattctcattcatataacgtttgagcaaatgcgggtaagaagttgcaatacgcctattagcaagatctttcacattctcataatgacaatcgcgatcaaccgcaagtgatagacgacaatcaccaaaatcaagttggcgaagttttttgtatgtaactgtttcatttgctgcacggcgaccaagctcttcctcttctaacacattttcgccaataatcccaagatccactacgccatcaaaaatcaatccaggaatatcatcatcacgtacgcgaagaatttcaatcggcaaattttccgcataagcgattaaacgttgttcattccaattaattttcacgccacattgtttaagtaatatggcacaatcctggcttaaacgcccttttttttgcaaagcaatacgaaggcggtttggttgcattgttgtgtttgtcataatgtttttcctattttaaagttgagataaaagaaaacccctcgaaaattgccttccgagggggtatttattgcttttacactgatttttattacactcggaagatattttattatcttccaaacatacaatcacgcctgaaagataatcaggtgtggtgatgatggtaagtgcagataaaattcatattgtatatgctcgctcaaatgttattagattttatattgccttaaaaatacactttaaaattaaaaaaagcaatttttttgaaaaaaattgtgtttttagtacatttttactatcgttaaaatttatcaaaaatgtttacttaagaggtataattttctagatttttattgtgttaattttcttttccctttctgtgttcatctcgttacaatacttagcgaatcaactaagacaaagctaagacaaaataggagagcttatgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaataggaaagcagaatgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaataagaaagcaaaaaagatcaggcattaccctgatcttttttctatttagtaaagtactctagcacgaattgtgccatcaatttccttcaattttgtcagtaatggtgatgcatcattcgtttctacatcaacgacaacgtaaccaattttcgggtcagtttgtaaatattgtgcggcaatattgaggttggcttcgacgaaaatttggttcagtttgttcaatataccagggcgattttcatgaatatgcaataagcgttttgttccctcgtgctctggtaaagagacttctgggaagtttaccgaagaaagggttgagccattatctgaatatttaacaaatttgcctgccacttcaaaaccgatattttcttgtgcttccgctgttgagccgccaatatgtggcgttaaaatcacattatcaaattcgcgtaatggcgagacaaattcttcattaattgaagcaggttcaacggggaatacatcaattgcggcaccctgaagtttcccgtcttttaaggcttgagcgagagcatcaatatctaccacagtgccacgcgcagcattgatcaaaattgccccttgttttaattgtgcgatacgcgttgcgttcattaagtttttggtggagggcagttctggcacatgtaatgaaaccacatcgcaagaactgagtaattcttcaaggctacgaacctgttttgcattaccgagcggaagtttattttcaatatcatagaaatacacatccatgcctaatgattcggcaataatacttaattgtgaaccaatgtggccgtaaccaataatgcctaattttttaccccgcacttcataagagccagtcgcggatttattccaaacaccacgatgtacttcggcattagcctgtggcacattacgcataagtaataaaatctcgcctaatacaagttctgcgacggaacgagtgtttgagaatggcgcattaaatacaggaataccacgtgcttttgctgcatttaaatccacttggttggtgccaatacagaaacagcctactgcgattaatttgggtgcggcttcaatcatttctgcggttaaatgggtgcgagaacgtaatccgataaaatgtgcatctttaatggcttcttttaattcatcaccatccagtgcttttttatagtaatcaatattgctatagcctgccgcgtggagcgtatcaagtgcgctttgatgcacaccttcaaacaatacaaatttaatttttgatttgtcgagtgaaactttgtttgtcatatttgcttccttatgatttttattatgaattagtcaataattttggcaccttcaggcgtgccgacgattacaacatctgcgccacgcaatgcgaatatcccattagtgacgacacctgcaacattgtttaattctttttccatttcaactggatttaaaatactgaagttgtgtacatctaaaatcacattgccattatctgtaaccacgccttcacgatactcaggtgcgccaccaagtgcgactaattttctgcccacttgtgaacgagccattggaataacttcaactggcaatgggaaagtcgaacctaacacatctacttgtttactagaatctacaatacaaataaattttttcgctaatgccgcaacgattttttcacgagtaagtgccgcaccgccgcctttaatcatcattttttgtggattgatttcatctgcaccatccacataaatatctaagctagagacatcatttgcattaaatacttcgatcccttgtttacgtaataattcttctgatgcttttgaagccgcaactacgccttgaattttatttttgattgtacccaaagcttcaataaagcagttcactgtggagccactgcccacgccaacaattgtgtcagctgttacatattctaatgcagcttgtgcggcgagttttttcatttctaattgattcatttcttttccttatttcaataagtaaacgattgcgttactttattacgagcctatctaataaacaagtataattttttagcgggcgtttttctcaagcaatgttctttcacgactagactatttcacgattaggctattcttcagttaaaaataattccaatagttcattgagaaataacttgccgtgctcagtgatttgccaagaatcagcgttttccacaatatagttttgttgaatggcaaaatcaatttgatttttcaccgcactttgcgacaagcctgtgtaatcttcaaattcttgtttgggaaccgcttctaacaaacgaaagcgattcataaaaaactcaaaagggcggtcaatttctggcacgtttttttcttcgtaaagatattcgccacgcaaataacctttcgggtgcttggttttagaaaagcgagtaatctcgccagtcggaaacgtcaatttcccgtgtgcgccacagccaatggctaaataatccccaaatcgccaataattcaaattatgtttacattgaaaacccgcttttgcgtaagcagacgtttcatattgctggtagcctgccatcgttaaaagttggtgaccttgctcaaaaatgtcccaaagtgcgtcatcatctggtaatttaggtgggcgataagcaaacatcgtatttggttcaatagtcagctgataccaagaaatatggggaggagatagctcaattgcttgacgaagatcatctaaggcttcttccaacgtttggttaggcaaaccgtgcattaaatctaaattgaaactttttagcccagaaactttcgctaaattgaccgcactttttgcctctgctgcattatgaatccgcccaagacgttgtaatttatcatcattgaaactttgaattcccatagaaattcgcataatgcctgcggatacataacctttaaaacgttcagcttctaccgtgccaggattagcttctaatgtgatttcaatattatcttcaaaatcaatctgtttttttatttcttttaagagatacgcaatgctttctgccgagaacaaacttggtgtaccgccaccaataaaaattgaatggagttttcgttgttgaatagaatctttaaagcgttgcaaatcagcctgcaaatcttgcagaagatgataaatatagtcttgttctggtatatcgcctttttgtgcgtgcgaattaaaatcacaataagggcatttttgaacgcaccaaggaatgtgtatataaagggaaagtgggggaagttttagcattgtgttattaacaagttttcaatttggaaaagtataaattaaccttgtgtaaagatgaaattatcatctctaaaatcaataaaagggcttgttttcacaagccctaaaacattcaattaattgaccgctctttctgatttactcgtcactttacggcgtggtgctttaggtttagccttcactttaacaaactcaatgccctctggtggattttccaatgcaaaaccaagcacttcatcaatggtttctaccgcatgaattgcaagattttgttttacgttttctggaattttttcaagatctttaacgttctcttttggaattaatacggttttaattccgccacgatgtgccgcaagaagtttttcttttaatccaccgattggtaatactttaccacgtaaactgatttctcctgtcattgccacatcagcacgcacaggattacctgttaaacaagaaattaatgcagtacacattgcaatacctgcacttgggccatcttttggtgttgcaccatctggcacgtgaatgtgaatgtcacgtttttcgtggaattcagcattgatacccagtttatccgcacgagcacgcacaacggtcattgccgcttgaatggattctttcatcacatcgcctaatgaaccagtgaaagaaagttttcctttgcccacaacagaggcagtttcaatagtgagtaaatcgccgcccacttctgtccaagctaaaccagttacttcgccaatacggttttgcgtgtcagctttaccaaattcaaaacgttttacgccaagataatcgtgcagattatctgaatttaccgtgatagatttaagttttggatttactaataaatttttcacggctttacggcagatttttgaaatttcacgttctaatccacgtacgcccgcttcacgtgtgtaatagcggataatatctaaaattgcactttcttttacggtaagttcgcctttcttcaaaccattacgttcaatttgttttgctaataaatggcgcattgcgatattaagtttttcatcttctgtataaccagaaagacgaataacttccatacgatccaataatgggcctggaatattcatagagtttgatgttgccacaaacatcacatcagaaagatcataatccacttctaaatagtgatcgttaaacgtggtgttttgctcgggatctaatacttcaagcaacgctgatgcaggatcacctcgcatatcggatgccattttgtcgatttcatcaagcaagaataatggattttttacgcccacttttgccatcttttgaattaatttacctggcaatgcaccaatataggttttacggtgaccacggatttctgcttcatcacgcacgccgcctaatgccatacgtacatatttacgaccagtagcattggcaatagactgaccaagagaagttttacctacacctggagggccaactaaacaaagaatcgggcctttcactttgtttaaacgcgcttgtactgctaaatattcaagaatgcgttcttttacgcgatctaaaccatagtgatcggtatctaaaacttgctgtgctttaacaatgtcttttttcactttagaacgttgatgccaaggcacttggatcatccattcaatataactgcgtattaccgttgcttcagaagacatggcagacatcattttaagtttttgtaattcattttctactttgtcacgcacatcagctggcatgcctgccgcttccaccttttgatgcagttgttcaacttcatcaatggtatcttcattttcgccaccatccatttctttacgaatggctttaatttgctcgttcaaataatagttacgctggcttttctccatttgtttttttacacgaccgcgaatccgtttttccacttggagaatatcagcctctgattccatcataccaagcaaatattctaaacgttcttgcacattagcgagttctaacgcattttgtttatggcgaatgcttacagggagatgggcagccattgtgtcagctaagcgatcaacatcatcaatacgttgaagggcattgagaatatctgtaggcacttttttgttgagggtaagataattttcaaactcagaaagtaccgcactttttgccaccactaactcttgttcatcgccataagtggtttcgataggggtaatttgggcggaaaagcacttttcgccgtcttcaagactgttaattttcgcgcgattttgaccttcaactagcacttttactgtgccatcaggtaattttaataactgaataatgttagcaatggtacccacatcaaataaatcttcaggggtaggttcttccaaatcagcttctctttgggataccaaaagaatctgtttgtcatcgttcatcgcttcttcaagggcattaattgattttacgcgccctacaaaaagtggcatcaccatataaggaaaaacgacaacatcgcgtaatggcaatacgggcattgtacgttgggtattcttcgccataattggtctctcttataatttcgttccgataatttgggtaaatattggggtagggaaaaaggaattcaaggaaaagattataacaaaatctgagttataaagtgggttttaaacaaaaaagaattttggcaaatgaagtgataatggctaaaataacgaaaaattttattaaatttcacaaaatattgagttatgtccacgaaaaatcattttattttccccacttacgttcaaatgtatccttattctaaggatcgcccttttcttaaacaagtgcgggaaaaattacgctattatggctataaatggttatatcaaaagcaatgtcatcaattagtggatttccttaatacagaaacgcaatggcagtctttatttacacaagattattatcgtactaatacaattctgacgaccttttgcgataaacgtttttctgcttcagaacgtttaacggcgattacggagaatttacgtttggcagaagaaaaaatgggacgttcgctttgccaacaattattagatcaacaacatatcgtgctaacccaattaactgaggatttgcgtttatcgttgagtattaatcatatcgatccctttgaaggatatttttctattaatattcgcaatcaaaataacgaacgagtatatgatgcgtctttcacttttttaagcccgaataaattgcttatcgcctcaattcaaggcccctcaagcgacaatgcacaagaacttgtgaaacaggctacgaaagcattacacggtatgcgaccaatgtttatgttggttaatgcgttcaaaatgcttgctgaaaaatggcaatgtgagttagtgggcattccgcacaaagcacaaggaaaataccgtctttctgctcgcagtaagattttgtttaattacgatgaattttggcaagaaaaccaaggagaatatcgccataactattggcaattacctttgcatattgaacgcaaacaattagaagatatcgcaagtaaaaaacgttctatgtatcgtaaacgttatgaaatgctagaccaaatggcactggatattcagcaactttaacgaagaaagtgcggtaaaaaatgagagaaatttttaccgcacttctcaattagttttcttgttttttcacttcatcccataacaaatctaattcaataagtggcacattattcacttgcttaccttgttgttgaaccgcttgctctactgctcgaaaacgacgttcaaattttaaatttgctttccgcaatgcatcttcaggatcacattttaagtggcgagcaagattgacggttgcgaacaataaatcgccgatttcctcttccactttattttgttcaatcgaagtgcggttaatttcagcttgaacttcttctaattcttcccgcactttgtcaaatacgggtgaaatttcttcccaatcaaaccctacttttgaacaacgtttttgtaattttgccgctcgcgtaagagaaggcaaagcacgaggcacattatctaaaatagaggtttcttcacttttaccttgtttttctttggctttcatttcgttccaacgggaaagggcttctgtttcgtcccccgcttttgcatcaccaaacacgtgaggatgacggcgtacaattttttcagcgatatcttgtaacacatcgtcaaaagtaaagtatttatcttccgttgcaagctggctgaagaaaacgacttgcaacaataaatcccctaattcttcacgtaaatttggtatgtcttttttctcaatggcttcgattacttcgtaagtttcttccgttaaacaaggaatcatggattcataattttgttttaaatcccaagggcatccgccatttggattgcgaagttgggcgatgagttgaataaaatcttgaatagagtagtgcataattttatttcctttgatggaatgttttggatagtataacgaacaagaaacatggtgcaaatgccgtcgctttttaggcgtattttctttatactttgtgcattgaaatactattgataaagctgggaaaaatggaaaaaattattattgatcatgatcgttttcttcgcacaatttcgcgtatttctcacgaaattattgaaaaacatcaaaccttagatgatcttgttattgttggaattaaacgccgtggcgcggaaattgcagaattattacaacgtcgagttgaagagttaagtggtataaatttaccttcaatggaactggatattaccttttatcgagatgatttaactttggttgatcaggaagataaaatgccagtttatagtggttcatcacaatatttgaatattcaagataaaaccgtcattttggttgatgatgtgttgtttactggtcgaaccattcgagcggcaatggatgcgcttactgattttggtcgtgctgcaaaaattgaattagtgatttttgttgatcgtggccatcgtgaattacccattcgtgctgattacgtaggtaaaaatgtgccaacaagccgtgatgaacttgtacaagttcgtactgaaaaacaagatggctgttacgaagttgctattctagggaaataaatcttatctattgtgaaccttcaatagaattgttactctaaccaacgttatggactcttttttgatgagatgaaaatgaaaaaatttattctaaaatcttttttattggctactttaggttgtgttgcttttacttctatggcacaagcggaggaacgtgttgtcgcgacagtagatggtattcctattttagaaagccaagttcgtgccaatatgggtaaaaaaggcgatcgccaaagtgcacttgataaaattattgatgatcttttagtgcaaaaagcgattcaagaatctggtgtgaaaattgatcctcgtgaaatcgatcgtgttgtggaagacactgcagctagaaatggcttaacttatggtcaatttttggatgcgttagattatcaaggcatttcattaaatacattccgtcagcaaattgccaatcaaatggtgatgggggctgtacgtaacaaagctattcaagaaagtattgatgtaacgcgtgaagaagtggttgcacttggtcaaaaaatgttggatgaggcaaaatcacaaggcactgcacaaaaagttacaggtaaagaatacgaagtgcgtcacattttgttaaaacttaatccattgttaaatgatgctcaagcaaaaaaacaattagctaaaattcgttctgatattattgcaggtaaaacaacttttgctgatgcggctttaaaatattctaaagattatttatcgggtgcgaatggcggtagtttaggttatgcgttcccagaaacttatgcaccacagtttgcgcaaaccgtcatgaaaagtaaacaaggtgtgatttctgcaccatttaaaactgagtttggttggcatattttggaagtaactggcgtacgtgatggcgatcttacagcagaagcctacacacaaaaagcatatgaacgtttagtaaatactcaattacaagatgcgacgaacgattgggttaaagcattgcgtaaaagagcgaatattcagtattttaataaataacaaagtatcaaaaataaaggggcttaattgccccttttgttgttttttattttctctttcttatagcttatgaagaaatttttaattgcgattttacttttaatttttattttagcgggcgtggcgagttttgcttattacaaaatgactgaatttgtaaaaacaccagtaaatgtgcaggcagatcaacttttaactattgaacgtggcacaacaggtttaaaattagccgcactttttgagcaagaaaagttaattgatgatgggaaattattgccttatttgcttaagttgaaacctgagctaaataaaataaaagcagggacttattctcttgagaatgttaaaactgtgcaagatttactggatttgctcaattccggtaaagaagtgcagttcaatgtaaaatggattgaaggaaaaacctttaaagattggcgaaaagatcttgaaaatgcaccgcacttggtgcaaaccttgaaagataagagtaacgaagaaattttcacattacttgacttgcctgatattggtcaaaatcttgaactaaaaaatgtggaaggttggctttatcctgatacttataattatacgcctaaatccacagacttagagctacttaagcgatcggctgagcgaatgaaaaaggcgttaaataaggcttggaacgagcgcgacgaggatttacctttggcgaacccttatgaaatgttgattttggcttctatcgtggaaaaagaaacgggtattgctaatgagagggcaaaagtagcctctgtatttatcaaccgcttaaaagcaaaaatgaaattacaaacggatccaacggtaatttatggtatgggtgagaattacagcggtaatattcgtaaaaaagatttagaaaccccaacgccttataatacttatgtgattgatggattgccgccaacgcctattgctatgccaagtgaaagttcgttacaggctgttgcaaaacctgaaaaaacagatttctattattttgtggcagatggttctggtgggcataaatttacccgaaatttgaatgaacataacaaagcggtgcaagaatatttacgctggtatcgcagccagaaaaatgccaaataaaagtgcggaagaaaatatgaaaggaaagtttattgtcattgagggcttagaaggtgcggggaaaagctccgctcatcagtctgttgtgcaagtcttgcatgaacttggtattcaagatgtcgtgtttacacgcgaaccgggtggaacgccactggctgagaaattacgtcatctcatcaaacatgaaaccgaagaacccgtgacagataaagcagagttattaatgctttatgcggctcgtattcagttggtggataacataattaaacctgcgttaatgcaagggaaatgggtggtgggcgatcgtcacgatatgtcatctcaggcgtatcaaggtggcggacgtcaattagatccgcattttatgcttactttgaaagaaaccgtattaggtgattttgagccagatctcacaatttatttggatatagatccaattgtcggtttagcgcgagctcgtggacgtggtgaattagatcgtattgagcaaatggatttagattttttccatcgcactcgagcacgctatttagcgttagtaaaagagaatccaaaagcagtcgtaattaatgctgagcagagtattgaacttgttcaagctgatatcgaaagagcggtaaaaaattggtggaaatcaaacgaaaaatgaccgcacttttaaaataaaaaatcggcagaaaatttcctgccgatttttttgttacaacttaacttaaaacgtccactgtaaattcagcgcaccttgtttagcgtgatgatgtttgcctgtttggcgattgaatgtagcttgtaaggttaagctcgtaggtcttttttgtcgccccctttccccgcatgttgtgtccgcgctccgctcactctctttcctttctccccccttttttgtttttggttctgtgtcgtctcccgccctgtggtctcgtcttcgcattcctctgttttgtttcccgccgcttgggtgctcttgttcaccgttctctttgtctctttttgctccccccatccttcttttctccttcccttgttttttttctcccccccccctttttccccccttttttttttttcctcgccccgcccactctccttcgttttctcttctatcgccctcatttttcccgcccgcccgcccttgcgcgcgaccaaatcttcnnttcnnttccccccctttcttttcccccccctccccttcccgcttttttttttttttgtcccctgcg

SEQ ID NO: 681 - DNA, 106645 bp, H. influenzae
cctgcagaacaatcttataggaccccttcatagtttttatgggaattaaaatgaccgattttagattaaacaaacatccctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaaaatagtgatacaaaaacaccaccaaaaattgctgaaacggtaaaaacggctaaaacgctggaaagagaacaagcaaacaatattaaagacatcgttaaatacgagacgggcgttactgttgttgaagctgggcgttttgggcaaagcggttttgccattcgtggtgtagatgaaaaccgtgtagcgattaatattgatggattacgtcaagctgaaaccctatcttctcaaggctttaaagagctttttgagggttatggtaacttcaataatacgcgtaatggtgcagaaattgaaactttaaaagaagtaaatattacaaaaggggcaaattcaatcaaaagtggtagtggttccttaggtggatctgtaatttataaaacaaaagatgcgagagattatctccttaacaaggattactatgtaagctacaaaaagggatacgctacagaaaataatcaatcattcaatacccttactcttgcaggacgttataaaaagtttgatgccttagtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaattaacagatgggaaaataacacgtcgagatggttcagaacttcaatttgaaaaaaaagataaaaatattgataacaacatctatgacttcgataaatttattgatactgatgatcgagtaatagaaggtaaactaggcctaaggagatcctctggaacttggtatgattgttcaatatttgattgtaaagataaaacaaaaatgaaaatttttgaaactgaacatccttatggctatggcactactggaacgtggaaaaaagactttgaacttgaaataaaaaaattaaatgacaaaaatttcgctagagtaaaggatgcgaataataaaacatactctattcttccctcatctccaggttatttagaacgcctctggcaagagcgagatttagacaccaacacccaacaattaaatttagatttaaccaaagacttcaaaacttggcgtgttgaacataatctacaatatggtagctcatataatacaacgatgaagcgaatggttaatcgtgctggtaatgatgcttctgatgtgcaatggtgggcagagcctacacttggttacagtttgttgtatgataaacctcacacttgtaaaaccgcttatggggggtggaaagctaacctttgccctcgagttgatcctaaattttcattcttattacccattaaaacaaaagaaaaatcagtctatctctttgataatgttgttataactgattatttatcttttgatttgggttatcgttatgacaatatccattatcaaccaaaatataaacacggcgttacaccgaaattacctgatgatattgtgaaaggattgtttattccattaccaagtggtaaaaataataatgatgatcctgaagttaagaaaaacgtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttttaaacctgtctaaaatcaaaagtgcggtaaatttttaccgcactttttcttaagaaaggatctaccttttactctctctttcaaagctaatgttcaaacatcggcatttgtgcaaaatctccttgaaaatcaacctctttttgctatttttgcgatctcgatcgaaagattgaaatgactatctcgccaaatttttagtttctatttatgcttacacatcaaaaatcaataacttattagttattgaaataaataagtaaataggataaattatgtacgagattctcttttacagagaccaaaatgacattgagccagtgaaagaatatctgctatcgctggctcaaaatgaaagcaaagatagtcgaattaaactgaataaaattcgagattatgtaatccaaacaacccaacaacgcttaagtgaattaaaagagagattgaaaaatgaataaaatcagcccattaggttcaaattggaatgagtttgaacagcaaattttcaatgaagaagaaatccgcgaaagtaatttacgtgtagccttaattaaagaattgattacttctcgccagcaacttgggatttcccaaaaacaacttgaaaccttaagcggtgtgaagcaacctatgattgcacgcattgaaaaaggacaaacgaatcctcaacttgaaacgttgttaaaattgctcgctcctttagggaaaaccctgtcgattgtgcctctaagggtaaaaaatgcctaagatatacccattattttcatattgacttgttatattttcattaagttttctcaataaatagtttttattgcaccttattatacctggcttttttgactagaaaatcgataaaatcggaatagactgttccgagaaaagaaaaaatattgcaaaatagcctcaaattaagacctattgtagaaaaatgattgtatttagtaatctgtccttaaaacgagggcaaacggagcttctcgaaaatgcttctgctaccattaatcctaagcaaaaagtcggcttggtggggaaaaatggttgtggaaaatcttcgctttttgccttattaaaaaaagaattaacgccagagggcggcgaggtaaattatccagcaaattggcgggtatcttgggtgaatcaagaaacgcctgcattggatatttctgcaattgattatgtaattcaaggggatcgtgaatattgccgtttgcaacaagagcttgaacaagcaaatgaatgcaatgacggtaacgccattgcacgtattcacgggcaattagaaaccttggatgcgtggacaattcaatctcgtgccgcttcgttattgaatggtttaggatttagtcaagaagaaacaacccagccagtgaaagccttttcgggcggttggcggatccgtttgaatttggcacaagctctgctttgtccatcagatttattattactggatgagccaaccaaccatttggatttggatgcggttatttggttagagcgttggctagtacaatatcaaggcaccttggtattaatttctcacgatcgtgattttctcgatccgattgtgacaaaaatcctccatatcgaaaatcagaagctcaacgaatacacgggcgattattcttcctttgaagtgcaacgagccactaaattggcacaacaaacagcgatgtatcgtcagcaacaacaaaagatttcccatttacaaaaatatattgatcgctttaaagccaaagccactaaagccaaacaggcacaaagccgtatgaaagcactagaaagaatggagctgattgcaccagcttatgtggataatccttttacttttaaatttcgtccaccgcaatccttgccgaatcccttagtgatgattgaacaggcaagtgcaggttatggcagcggagaaagtgcggtagaaattttaagtaaaattaaactgaatttagtgccaggttcgcgcattggtttactcgggaaaaatggtgcaggaaaatcaaccttgattaaacttttagcgggagaactgaccgcactttcaggcacagtgcagttggcaaaaggcgtgcagcttggctattttgctcagcatcaattagatactttacgcgcagacgaatctgctctgtggcatatgcaaaaactcgcaccagaacaaacggagcaacaagttcgagattatttaggcagttttgcgtttcacggcgataaagtaaatcaagcagtgaaatctttttctggaggagaaaaagctcgtttggtgttggctttgattgtttggcaacgcccgaatttattactacttgatgaaccgactaaccatttggatttggatatgcgtcaagcattaacggaagcattggtagattacgaaggttctttggtggtggtgtcgcacgatcgtcatttattacgcaataccgtggaagaattttatttagttcacgataaaaaagtggaagaatttaaaggcgatttagaagactatcaaaaatggctgaatgaacaaaatagcacatctgaaaataaagtttcggaaaaagtgggcgataatgaaaattcggttcaaaatcgtaaggaacaaaaacgccgtgaagcagagttacgccaacaaactgcaccattacgtaaaaaaatcacgcaattagaagaaaaaatgaataaattttcttctgagcttgcgaacatagaaaatcaactggcagatactgaattatataatgcggaaaataaagaaaaattgaccgcacttttggctcaacaagtggatgtgaagaaagcattagatgatgtagaaacggaatggatgactgcacaggaagaattggaagaaatgcttcaagcgtaaggatagattatgaatcaaagcctttttcatcatagcaaacaacaggaatattgccctcaatgtggtgcgcttttgcaaattaaacaaggcaaaaaagggctgtttttaggttgctctgcttatcctgaatgtgattatttgcgtcctttgcaacgatcggagcataaagtattaaaaacatttgatgaaatttgcccgaagtgcggtaatttattgcagttgaaacaaggcagttttgggatgtttattggttgtagccattatcctgaatgcgattttgtggtgcgggaagaatctgaatctgaggaaaaaattacttgtcctgaatgtaaaacggggcatttgatttctcgtcgtggtcgccaaggaaagattttttacggctgtgataatttccctaaatgtaaattttctttgcctgccaagccttattccgtgccttgcccaacgtgccattttcctctttctttgttaaaaagcgaaaatggggaaaaacaaattttccagtgtgcaaataaaacttgccgtcatatttttgagcaataaaagtaaaagaatgaaatgaatagagaacaaatcgccgaagcccttcgacaaaatcaagtggttgcttatcccactgaagctgtgtttggtttgggctgtaatccgcaaagtgaaagtgcggtaaaaaaattactcgatttaaagcaacgtccagtggaaaaagggctgattttagtcgctcctagcttggattttttccgtccttttgtcgattttgagcagattaacgatgaacagctttctcatctgcaaggtaaatatgaacgtccaacgacttggattgtgccagctaaatccaccacctcgcattttctcacaggaaaatttgatagcattgcaatacgtttgtgcgatcacccatctgtgaaagccttatgtgaactcacgggttttgcattaacttcgactagcgcaaacctaacaggagagccaccttgccgtaccgccgatgaagtgcggttacaattcggtgcagattttcctgtattggatgaaattgtgggagatgcacgcaatccatctgaaattcgagacttacgcacaaatcaactttttagacagggataatttatggatctttatgctgtatggggcaatccgattacgcaaagtaaatcgccattaattcaacgtcagttagccgcgcaaacccatcaaactatggaatacatcgcaaaattaggcaatcttgattcttttgaacaacagcttttggcattttttgaggagggtgcgaaaggttgcaatattacttcgccttttaaagaacgtgcctatcaactggcagacgaatatagccaacgagcaaaattggcggaagcctgtaatacgctaaaaaaactcgatgatggaaaactttatgcggataacaccgatgggattggtttagtgacggatttggagcgtttaaattggcttcgtccaaatcaacacgtattaatcttgggggcaggcggagcaacaaaaggcgtattattgccacttttacaagctcaacaaaacattgtgcttgctaaccgcactttttcgaaaaccaaagaattagctgaaagatttcagccttacggcaatattcaagctgtctctatggattcgattccactacaaacctatgatgtagtgattaatgcaacttccgctggattaagtggtggaactgctccagttgatgttgaaattttaaaattaggcttagctttttacgatatgcaatatgcgaaaggcacagacacgccatttatcgcattatgcaaaagtttaggtttaaccaatgttagcgatggctttggaatgttagtcgcgcaagcagcacattctttccatttatggcgaggcgtaatgccagattttgtcgcggtttatgagcaattaaaataaggtaattggcaatggaaaataaatacagcgattttatggtgtatgtcgatgaaagtggagatcacagtttacagtcaattgataaaaactatcctgtgtttgtacttgcattctgtattttttataaagaccattatcgaaataatattgttccacagatacagaagataaaatttgattattttggtcatgatatggtgatattgcatgagcatgaaatccgcaaagaaaaaggcgattttaatattttcacttctcgtgaacagcgtgaaggttttatggaacgtatttcatctattattgaaaatactaattttattcttgctgcctgtgtgattgataagcgaaaaacgccacaaaatgaaacaacacacccttatcatttttcactcaaacattgtttagaaaccctatacgaatttgtttgtgaaaagcatcaagaagataaaatcacttttgttgccgtggaaagccgtggacgtaatgaggatagagagttagagctggaatttttacgtatttgtgatggacaaaataaatttaaaaagtccttgccttttcaagtaaagattgtgccaaaacaaattaattctgtggggttgcaagttgcggatttagtggcaagacctatcgggagacatattttagatagtaatcaaccaaatcgagcctttgagatccttaaaaagaaattttattgtgaaggtggaagaaaaatactgggggaaaattttgatcaaaaaggactgaaacatttcccttagccctaaaaagcgaaaagcctcaatgaaactcactgaagctataacgccgaccaagcaccctcgatccacttggctcggaatatatcaaaatgttttattttgtcaagttttaatatgcaacaaataaccagatgcccttgggttggcgaacaacctatttatattgattatcatgacaaggaatggggaaagcctgaattcgacagccaaaagctatttgaaaaaatttgtttggaagggcagcaagcgggactttcgtggattacggttttgaaaaaacgtgaatcttaccgtgcagcctttcatcaatttgatccgaaaaaaatcgcaaaaatgaccgcacttgatattgatgcttgcatgcaaaattcaggattaattcgccatcgagccaagttagaagccattgtcaaaaatgcgaaagcttatttggcaatggaaaagtgcggtgaaaatttcagtaattttatttggtcatttgtgaatcataaaccgattgtcaatgatgtgcctgatttgcgatctgtgccaactaaaacagaagtatcgaaagcactttctcaagccttaaaaaaacgtggtttcgtctttgttggcgaaaccacgtgctatgcgtttatgcaatctatggggctggtggacgatcatttaaatgattgtccttgcaaaactcgctagtgtttatgctgatctcgctcccataaatcggcgtattttacaaaggttgaatgcgctgataacaccgctaataaaaatccttgtttgccatctaaaaaacccgcttttaacaaatacatcttcacaaaacaaccaagcgcgtgcgaaattccttgccaaagtgtggctttttttcctttagcttggcgttggtctgcccaggctttggcataacctgcggatttcactagataatgatgaatacttttataagtgaaatgctctaaatcccctgtcaatttttctacttttgtgccagctggaaattccactttttcatgtacaagtgaatcattatattgcgcatagtttgtgcgatagagacgaactacataatcgggataccagcctgaatggcgaatttcacgcccaaatacttcactcactcgtggaatttcataaacggtattttctcgatcatttttaaccgcacttaagatagcctgttgtaacttgggcgtaacgcgttcgtcagcatctaaccagagtacataatcactggttacatattgttgggctaattggcgttgtttaccaaatccttgccagtcgctattttcatagaatttagccccataactgagcgcaatttctttagtgttatctgtgctaccagaatctagaatgataatctcatccacccaatcttttacggtgtctaagcaattggcgaggtcttgtgcttcattttttacaatcatcgcaacgctaattgtaggcatattttcaatcctttttttgctatactagccgaaattttttcaagtataaccgaatttcatttatgtggcgttttttttataccagcttgcttttaatttgccagccgttgatattgtgttttattggcttgctcagtgttaaatctccacgttatcgtcagcgtttggctgaacgttatggtttttatggcaatgtgccttgtccaccaccacaaggaatctttatccacgcagcctccgtaggggaagtgattgctgcgataccgctggttcgtcaattgcaacaagattatccgcatttatccattacttttacgacttttacgccaacaggttcagagcgcgtcaaagccacttttggagacagcgtttttcattattatctcccccttgatttacctttttcgatccatcgttttattaattttgtacaacctaaattatgtatcgtgatggaaacagaactttggcctaatcttattcatcaattatttttacgcaatattccatttgttatcgctaatgcacgtttatctgcgcgttctgcacatcgttacggaaaaataaaagcgcacttacaaacaatgtggtcgcaaattagcttgattgcagcgcaggataacattagtggaaaacgctatgccactttgggctatccaaaggaaaaattgaatatcacgggcaatattaaatatgatctcaatacgaatgatgaactattacgtaaaattgattcattgcgaacgctttggaaacaagatcgcccaatatggattgctgccagcacgcataatggagaagatgaaatcattttaaaatctcaccgcgctttgttagcaaaatacccgaatttattgttattgctcgttccgcgccatccagagcgttttaatgtggtggctgatttacttaaaaaggaaaaatttcaatttattcgtcgttccacaaatgaattaccaaatgaaaatacccaagtgattttgggcgatagtatgggcgaactgatgttgatgtatggcatttccgatattgcttttgtgggtggaagccttgtgaaacacggggggcataatccactggaacctcttgcgtttaaaatgcctgtaattactggcaagcatacttttaattttcccgagatatttagaatgttggtggaagtgcaaggtgtgttggaagttaattcaaccgcagattccttagaacgcgccgtagaagccttattaaactcaaaagaagcccgcgaacgtttaggcaatgctggctatgaagtgctgatggaaaaccgaggggcattacagcgtttgttagatttattaaaaccttatttggagcgcaatgtatgacgagcgtgatttatcctggtacttttgatccgattacgaacggtcatttagacattattgaaagaagtgcggtaatttttcctcgtgttttagtggcggtggcgaatagcccaagtaaaaagccactattttcgttggaggaacgcgtggagcttgttcgtcaatctgttgcacatttatccaatgtggaggtgtttggcttttctgatttgttggcaaatgtgattaaacagcacaatatttctgccattattcgcggcgtacgcacaacaacagattttgaatatgaactgcaattggccgcccttaatcgtttactcacaaaaggcgtagatagtctgtttttcccaccagcagaaaaatgggcgtttgtttcttctaccattgtgcgtgaaatttatttacatggcggagatgtcgctgagctagttcctgagcctgtattcaatgcgttaaaagcacgatgataaaaacctttatttttttaaccgcacttatcgttttatctggttgtggttccgtggtcaaacttatcgatccaacagaaaaatataccgcctatgcaggggttgcttatgatcttgaaatggcgcaacaatggggattgccaatcttagatttgcctctctcatttttattagacactgtattactgccctatgcgtgggctcaataattcttatgaaactcaatcctcaacaacaacaagccgttgaatatgtgacaggcccttgccttgtgcttgctggcgctggttcaggcaaaactcgcgtaatcattaataaaatcgcccatttaattgaaaagtgcgggtattctccgaaacaaattgccgccgtcacttttacgaataaagccgcacgcgagatgaaagagcgtgtggcacattccattggcaaagaacaatccaaaggattgcttgtttccacttttcatacgctcggttttgacattattaagcgtgaatataaagcgttgggctttaaatcaaatatgaccttgtttgatgagcacgatcaatttgcgttgttaaaagagctaaccgctgatgtgttaaaagaagataaggatttattgcgcgagttaatttcagtgatttctaactggaagaacgatttgatttcgccaaaacaggcatttgccttggcacgtgatgctaaatatcaaactttcgcaaaatgttatgagcgttacgccacacaaattcgagcttacaacgctctcgattttgatgatttgattatgctgccgacattattgttcaagcaaaatgaagaagtgcggtcaaaatggcaggcaaaaattcgttatttgttggtggatgaatatcaagacaccaacaccagtcaatatgaactgattaaacttttagtgggtgagcgtgcttgtttcactgtggtgggcgatgatgaccaatctatttattcgtggcgtggcgcacgaccagaaaatatggtgcgtttacgcgatgattttcctcgtttgaacgtgattaagctagagcaaaattaccgttcaacccagcgtattttgcattgtgccaatattttgattgataacaatgagcacgtgtttgataagaaacttttttcaaccattggtacaggggaaaaattgcttgtcatcgaagcaaaaaatgaagaacacgaagcagagcggattgtcgccgagttgatcgcccatcgttttagccgtaaaaccaaatataaagattatgcgattttgtatcgaggcaatcatcaatcccgattactcgaaaaagtactgatgcaaaaccgtattccttacaaaatttcgggcggtacttcttttttctctcgtgcagaaatcaaagatatgatggcgtatttgcgcttggtggtaaatcaagatgatgacggagcattcctgcgtattgtgaatacaccgaagcgtgaaattggcaccgcaaccttacaaaaacttggagagttggctcaagaaaaacacatcagtttgtttgatgctatttttgagtttgaacttattcaacgcattacaccaaaagcctatgattcattgcaaaaatttggccgttggattgtagaacttaatgatgaaattcaacgttctgaaccagaacgtgcggtacgttctatgttatctgcgattcattatgaagaatatttgtacgaatacgcaacaaaccctaaagcagcagaaatgcaaagtaagaatgtcgccacgttatttgactgggttgcggatatgttaaaaggcgatgaaaccaatgagccgatgaaccttaatcaagtggtaacccgcctgacattacgcgatatgttggagcgaggcgaagacgatgacgacagcgatcaagttcaactgatgacattacacgcatctaaaggattggaatttccttatgtttatttgattggtatggaggagggcattttaccccaccaaaccagcattgatgaagacaacgtggaagaagaacgccgcttggcttatgtgggtatcacaagagcacaaaaagaacttactttttctttatgtcgtgagcgtcgtcaatatggagaattagttcgcccagaacccagccgatttttagctgaattacctaatgacgatgtgctatgggaacgcgataaaccaaaactcaccaccgagcaaaaacaagaaaaaacacaaaaccaacttgatagattgagggcgattttgaaaagttaataaaaatcggcagggaaattctctgccgattttttattttaaaagtgcggtcatttttcgtttgatttccaccaattttttaccgcactttcaattccagctaatgtagccaatgtagggtgggcttaagcccacgcgtttaactagggtttattccctacgggctgtaatcttccttatagtctagaaataacgtggcagacaaatagacttttaaaaattaacgtaaaaaggcataatggcaaccccattttttataattatttaggagcaaaaagatgaatattttattattagacggcggtaaggcgtttggtcattctcacggcgagttgaaccattcgcttcacaaaaaagcgaaagaagttttgaccgcacttggacacaatgtcaaagaaactgtaattgatgctggttatgacgttgaagctgaaatcgaaaaattcttgtggatggatgccgtgatttggcaaatgccgagctggtggatgcatgagccttggacagtgaaaaaatacatagacgaagtattaaccagtgggcacggcaagttatatcacagtgatggcagacacagcgttaatccaaccgagggctatggcacaggcggcttgttgcaaggcaaaaaacacatgctttcactgacttggaatgcaccgattgaagcctttactcgcgaaggcgatttctttgaaggcaaaggcgtggatgttttgtatatgcatttccacaaactcaacgagttcatcggcttgactcgcctgccgacattcttatgtaacgatgtggttaaaagtccgcaagtagaacaatacttagcagactaccaagcacacttggaaaaagtgttcggctaataaaaaaatccatcttcaatacgaagatggattttttgtttatttcgttgagattgttgttacttaacaactgccccacaaatcatattcatcagaatttgtgatggttactttaatcacgtcaccgactttgacattgattccgcttaaattatctacgtaaactaacccatctacttcaggggcatcggcttttgaacgaccaataataccatcttcgtcaatttcatccactaatacatcaagggttttaccaattttttgttttaaacggtttgcagaaatttcttgttgtaattgcatgaagcgatggaaacgttcttcttttacatcttctggtacttggtcagccatatctgttgcgggtgcaccttcaacagggctgaatttgaaacagcctacgcgatcaagttgggcttcttttaagaaatcgagtaataattggaaatcttcttccgtttcgccagggaaaccaacaataaaggttgagcgcaatgttaaatctgggcaaatttcacgccattgtttaatgcgttctaaagtgcggtcaatactgcctggtcttttcattgcttttaagattttagggctggcgtgttgtaatggaatgtctaaatacggcaatagcgtaccgtcagccattaatggaattaaatcatccacatggggatagggatacacataatgtaagcgaacccaaatgccaagttttttgggcaaccaaggcttacaaagccaatgcttggggttgaattttgcataaaaataaccgttttcgctctataaaatttcaaacgcaagattttactcaattttcgcaagaaaggcgataaattaaaggcttggaagggtaaagattttaagctaagtgatgtagaatagacgagtatgtctgacttatttttatcactatggaaaattcatctttacttttaaccgcacttttcaatcctgatcacttaattatttttagcaaaatgctattagcgatggtgcttggcagtgttattggcttagaacgtgaacttaaacgtaaacctgtgggtgtaaaaacttgtgccattattgccgttaccacttgtgtgctaaccattgtttcaattcaagccgcagagcattatgcacaagtttcagaaaatattcgtacagatccaatgcgtcttgcggctcaagtgattagtggcatcggttttttaggtgctggtgtgattttgcataagaaaaatgatgcgatttcaggtttaaccactgcggcgattatttgggcttctgcggggatcggtattgctgctggggcgggtttcgtgtttgatgcggtcatcgccactgtgatgattttggtgtctattcgattaagtccgttggttcaacgttgggttcatcgtaaatcacaacgtcgtcggacgaaattcaatattcttgtcaatgatgcggaaagcatagggaaagttacccaattgttagtaaataatcagtatcgtattgaacatatacaagtcaaagatcaaagtagtggagaagtgcggttacaaattcgttgcttttccattgattccacaatgttgaaagatgcgtatgctttacttaaagcagaagatggcgtaataagtgttgaagtagataactagaaaaagagtgattaaattaaattttcttttaaattaaccacacttttttattttttatttaatttctttcacaaaagatcaattttcattaaaaatacttgattttgctaacgctatcttgtaattaataatgctattcaagcacaacaaactaaggaaacaacaatgaaaaatgtaggctttatcggctggcgcgggatggtgggttccgtattaatggatcgtatgtcgcaggaaaatgattttgcaaatcttaatcccgtattttttacaacttcacaagcaggtcaaaaagcacctgtttttggtggcaaggatgcaggcgacctgaaaagtgcattcgatattgaagaacttaaaaaattagacattatcgtgacttgccaaggtggcgattacaccaatgaagtctatccaaaattaaaagcaacaggctgggatggttattgggttgatgccgcttctgcgttgcgtatgaaagatgatgcaattattgtgcttgatccagtaaaccaacacgtgatttctgaaggtttgaaaaaaggcattaaaactttcgtgggcggtaactgtactgtaagcttaatgcttatggctatcggcggtctatttgaaaaagatttggtggaatggatttctgtggcaacttaccaagcggcttcaggtgctggcgcaaaaaatatgcgtgaattactttcacaaatgggtttattagaacaagcagtttcaagtgaattaaaagaccctgcttcatctattttagatattgaacgtaaagtgacggcaaaaatgcgtgctgataacttcccaacagataactttggcgcggcattgggcggtagcttaatcccttggattgacaaacttcttcctgaaacagggcaaactaaagaagaatggaaaggttatgcagaaaccaacaaaattttaggtttaagcgacaatccaattcctgttgatggtttatgtgtgcgtatcggtgcattacgttgccacagccaagcgtttaccattaaattgaaaaaagacttaccattagaagaaatcgaacaaattattgcatcacataatgaatgggtaaaagtaattccaaatgacaaagaaaccacattacgtgaattaacgccagcgaaagtaacaggtacattaagcgtgccagtggggcgtttacgtaaattggctatggggcctgaatatttggcagcttttaccgtgggtgaccaattattatggggtgcggcagagccagttcgccgtatcttaaaacaattggtggcgtaagtttactttcactacaaagggcgtatttactacgcccttttcattaaaaaattatgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataattagtagcttttcactcaaaaatagatttaatgtgtagataaaatattcaaacaaaggtgtttttcaaaaaatggtttgacatattttctaaaaaacgtattataccgctcacactgattgtggtgagatggccgagcaggctgaaggcgctcccctgctaagggagtatggggttaaaagctccatcgagggttcgaatccctctctcaccgccattgtttgttttatttattctgcacccgtagctcagctggatagagtactcggctacgaaccgagcggtcagaggttcgaatcctctcgggtgcgccatttttaaaacggctctatcttattaaagtggttatgaataattaaagcatcatctacgcacccgtagctcagctggatagagtactcggctacgaaccgagcggtcaaaggttcgaatcctttcgggtgcgccatttctacattgttactttcattaaaatattctttactattcaacatatttattatatttctttcttgtatctatttatttttaattatttaaaatatgaaaaaacaatctttaccaactaaatttagtccatttgcttggggtcttgctgccttttgttcgcctatattattgtgtccaatggcattattaatttctacagcatttagtaaaaatccctatctatcaagctggcaaatcaatttattttcaacgcttttttgggtttatccctttattctagctgttacagctagaatgctataccgtcttcatcaacataaacctaaactagcaaataaattattaacattaagtgcggtcattttttatgtgattttaattacgatttgtaaaattggtttataaaaaaatcctacgataatacgtaggattttttattctattttttctttattggtcgttgccaaccttgaatatgtcgttgagcaactcttgtaatcactaattcattttcgccaacatcacgtgtaattgtagtcccagcaccaatagttgcgccatttgcgactttcactggcgcgactaattgtgtatcagatcccacaaacacatcatcaccgatgatcgttttaaatttatttgcaccatcgtagttgcaggttatgacacccgctccaatattacaatttgagccgatttctgaatcgccaacataagttagatgatttactttagaacctttaccaacggtagattttttaatttctacaaagttaccgacatgcgtttcagctgcgagttctgcacctgggcgtaaacgagaaaatgggccaattgcggctttttctcctactatagaatcctctagcactgaatagggttttatttctacatcattgccaataacaacatttttcaatacgcaacctgcgccaatttttacgcaatcaccgagtttaacattaccttcgataataacattaacatcgatttccacatcttttccatgctctaatgttccacgtaggtcaaaacgagcgggatcgtagatcattacgccttcaagtaataatttggaggcttgtttattttggaaataacgttcaagtgcggctaattgtaagcgattatttgcgccttcaacttccatgacatctgttgcttgtacagcaacaacttggcaattatcttggtttgcgagagcaataagatccgttaagtaatattcgccttgagcattattattacctacacgagctagccattttttgaaacttgcaccatcagataccataacgccagtattgacttctttaatatttagttgctctgcatttgcatctttttgttctacaatggctacaacattcccattttcacggataattcgtccatagcctgttgggttatctaaatttacggtaagcaatgcaatgccattttctggtttcgcttcaattaatttttctaatgtttctttagtaattaatggtgcatcgccgtaaagtacaacaatgttttcgttatccttaaaaaaaggagctgcttgttgaactgcatgtgctgtgccaagttgttctgtttgtaatacccagtttacttgttcatttgcaagatgggtacgcattaagtccccaccgtgaccatagattaaatgaatattttctgagcctaattgatgggcaatatcaatcacgtgttttaccattggtttaccagcgattgtatgtagcactttgggtaaatcggaatacatgcgcgttccttttccagctgctaaaattaccgcacttaatgctttttttgtcataaattttctctttattcatcaataaaaacgggtaatattctatcttagaaagatagcaaatggtaagtttttaagtaaaagctataacaaacttttatataagaaaaaaccgatggtttcccatcggttttttgaattttaaagtggttaaaatagaattatttaacttctacttctgcacccgcttcttctaattctttcttaagtgcttcagcttcttctttagaaacgccttcttttaagttagctggagcagattcaactaaatctttagcttcttttaagcctaaaccagttgcaccacgtactgctttaattactgctactttgttcgcacctgcagatttaagtacaacgtcgaattcagttttttcttctgctgccgctgcgccgcctgctgctggagctgctgctactgctgccgctgctgaaacaccgaatttttcttccatcgctgcgattaattcaacgatttcagttacagtttttgaagcaatcgcttcaatgatttgttcgttagttaatgacataacaatcaattcctaaaataaataaagttagatgaagtaagaaacgcttaatgattaagctgcttcttgtaatttgtcgcgtaatgccgcgaaggtgcgagcaagtttgcctgctgcagcttctttcattgtgcccattaaacgtgcaatcgcttcttcgtaagttggtaatgttgccaagaattcaacatcttggattttaccttcaaaggctgcacctttaatttcaaacttatcgtttgctttagcaaactctttgaacaaacgagcagcttcgcccgggtgttcgttagagaacgcgataagtgttggacctacaaacgtatcttttaagcattcgtaatctgtgccttcaactgcgcgacgtaataaagtattacgaactacacgcattgtaacgccagcttcacgtgctgatttacgtaattcagtcattttctcaacagttacaccgcgagaatccgcgattactgctgaaagtgcacctttggctgcttcatttacttcagcaacaattgcttgtttgtcttgaagatttaatgccattggcttttagctcctgaatacactccgattactcggaattaatttacctaatcctaagattaggatgacttcggcgcccagaagcaagaaaaattcttattctgttcaccatctacgtaggataattaagattactcccctacggtcttggatggggcttgaataggtcaagcaccaaccagaaatttgttagattgactaacacaggcgcaggattatagagaaaagctatgttcttgtaaagaatattgttggaaaaagagccaaattcctatgatagcttctctactaattccactgcagccccaatataagtagcgggtgttaatttttgtaaacgtaatttttcttcttgtggaatatccaacttatcaataaattcacgcatagcctgttctgtcactcgtttacctcgcgttaattcttttaatttttcgtaaggtttttctattccgtagcgacgcattacggtttgaattggttcagccaaaacttcccagttttgattgagttcttctaataagtgcggttgatttacttcaagtttactcatgcctttgcgtgttgaagcataagcgatcaaacaataacctaatcctacgcctaaattacgtaatacggttgaatctgttaagtcacgctgccagcgagaaattggtaatttttgacctaaatgggtcatcactgcattggctaatcctagattgccctctgagttttcaaaatcaattggattgactttatgtggcatggtagaagaaccaatttcgcctgctatagttcgttgtttaaagtgatttaatgcaatgtatccccataaatcacgatcaaaatcaatgataatggtattaaagcgaactacagcatcaaaaaattcagcgatgtaatcgtgcggctcaatttgtgtggtataaggattccattgaatacctaatgaagtgacaaattcttcgctgaatttatgccaatcaatattaggatatgccgataaatgcgcattgtagttacctactgcaccattgattttacctaagatctccgcattttggagttgtttaaattgacgttttaggcgataaacgacattcgccatttctttgcccacggtgcttggtgaagctggctggccatgtgtgcgagaaagtaatggaatcgttttatattcttctgcaagacgagtgatttcatcaatcagtttttgccattctggtaaaatcacttcgtcacgagcggtgcttaacattaatgcgtgagagagattgttaatgtcttctgaggtgcaagcgaagtgaataaattcagaaacgttcactagttccacttcgttttgaattttctctttcagaaaatactcaacggctttcacatcgtgattagttgtgcgttcaatttctttaatacgcgcagcatcggcctcattaaaattagccacaattccatctaaaaaagcatttgcttgcgtagaaaatggcggtacttcggtaatatctgccgttgaagctaatttttgtaaccaacgaacttccacaactacacggaatttcattaacccgaattcgctaaaaatagcacgtaatggcgttactttatcttgataacgaccatcaagaggggaaagtgcggtcagtgtagagagttgcataaatgtttactccagaattgtattaataaatagaagaataaatctgttttgcggtggcaagtaattttctgcggaaaaataaaatttgccattttgttccgcccatttgtttccacagcacggcagagcgaatgcctgcaagtaaaactgcacggattttattttgcacgagttcttgtcgcaaataatcaggcgagcctaggatgtgaatttttttacccaatgggctaataatatcgctgtaaatatttgccataatagataacattgtttcactatcgcgagcgtaatgaatttcttgttcttttaggcgagaaattcgattgcccaatgtttgtttggcatcggagtttttcgataattttccttctaatgctaaaaggcttagccaatagcgagttaaattttgatcgccttgcgcgttgagctggtgaattaaggtttctagacctaattttaaatgacgaacttcgccaccaaaaacatcttcaattcgttgtggttgggtaatgaaaaggctattaagtgcggttaaaaatgtatctgaatctgctcgactttctgttgcaagttgatgaaccaattttgctgattggcacacgccagcaagggcaagaacaatatcgtggtagtttttcattagtaaatattaggaaaacgtttccgttaaatatagcatttttaacctagcttttgaactcgaacattaaaaaagcctagagtttctgatatgatgtgtgaacagttttaaggtattaaggattgattatggcaaaaccaattgtttttagtggcgtgcagccttctggtgaattaactatcggaaattatttgggtgcgttgcgcaactgggtgaaaatgcaagaagattatgaatgtattttttgcgtagttgatttacatgcgatcactgttcgtcaagatcctgttgcccttcgtaaagcaacgcttgatgtgcttgcactttatttagcgtgcggaattgatccaaataaaagtactatttttgttcaatctcacgttccagaacacacgcaattaagctgggtgttaaactgttacacctatttcggtgaaatgagccgaatgactcaatttaaagataaatcagcgcgttatgcagaaaatattaacgtgggtttgtttgattaccctgtgttaatggcggcggatattttactttatcaagcaaaaagcgtgcctgttggcgatgaccaaaaacaacacttagaaattacgcgtgatattgcaaaccgctttaatgcgctttatggcaatattttcactattcctgaaattttcattggaaaagcaggcgcgcgtattatgtcattgcaagatcccgaaaagaaaatgtcaaaatcagatgataaccgcaacaatgtagtgacacttttagaagatccaaaatctgtggcgaagaaaattaaacgtgccgtaacggattcagatgagccgcctgttgttcgttatgatgtgcaaaataaagcgggggtatctaatcttttagatattctttctgcggttacggataagccaattgctgatcttgaaaaagaatttgaaggtaaaatgtacggacatttaaaaactgcagtagcggatgaagtctcaactttacttgctggtttacaagaacgtttccatcaatatcgcaatgatgaaactttattagataatatcttacgacaaggtgcggaaaaagctcgtgcaaaagcacaagaaaccttggcgaaagtgtatgaagctgtaggttttgttgctgcaaaataatctgaataaaagggataatattatggcaattcaaactgaaaaaccgattgaatgtgtaggttgtaacacatttgatatgaaatcacttttcgataatcgtgattgtagtcaggttattgaatatatttatgacagtgaagaacaagcgcaagaagcactcgcattttttactcagaaagcgcgtgatgtagaaagtgaaccttgtgaaattcaatctgaaattacaaaactggatgatggctatttattaaaggcagatttcactttctgttgccaagctgaattggtgatttttcaaatgcgtattgcgtaagaaaaacagctgaaaaataagccgcacttttgcggcttattttgtgattagtgttctacaaagcttaaggcggtttcaattacttcaactcccgcaccttgtttaaacgcattttcacttaaatagcgtcgccattgacgggcacctttgcaattttggaatgcgcctagcatatggcggacgatatgattaaggtgtattccttggttaagttgttgttcaatataaggaagcattgactgtaccgcttcatgagcggtaacaattgcagcgttaggatcaaataaggcttggtcaatttgcccaagtaaacttggattttgataggcctctcgcccaaccatcacgccgtccacatattgcaaatgttgtttcatttcttcaatggtttttatgccgccattaattgcgatagttagatgtggaaaatcacgttttagttgatacactcgagcataatctaatggtggaatttctcgattttctttgggacttaaccctgaaagccaagcttttcgtgcatggataataaactcttggcaaccttttccttgaaccttctcaataaaatcacataaaaattcatagctgtctaattcatcaataccaatacgtgttttcactgtgactggaattttgaccgcactttgcatttgttctacacagtcggccaccaaatctgctttcgccattaagcaggcgccaaacattccattttgtacgcgatcagaagggcatcctacattaagattaatttcgtgataacctcgttcctcagcaagttttgcacaatatttgagttgttcaggatcacttcctcccagctgtaacgcaacgggattttcttgtaaatcaaaatccaagtgatcgtatttggcatggataatcgcaggcgcagtgaccatttcggtgtaaagtaatgcgtgctttgaaaattggcgatgaaaataacgacaatggcgtgttgtccaatctaacattggcgcaacagaaaaacggccgcggtaaaagtgcggtagattttgaggcatttttatttctcttgtttggttttgctgcgtaattcttcggcttgacgagcttgcatttgctggcgaaaacggcctgcagcaaagtggtaaaatggtttaggactaaattggcgcgagattatggatgcaataatgctggaaatcaagagccaaatgagaacgagttgcgcgcctgtcatttccactccaacagtgcggcaagcactaaacccaataataaagcaatataaataggatgttggcgaacccagccacgccatttttcaggtgataatcctgcgataccttttgctaataatcgtccaaatatgccacctagaatgccataacccaccccacaaattgcaagccaaagatagagacaagaaaccgatgttgccccttgataacgtggaaaataagggctgtttccttgaatcgcgacaagaataaaaccagtagctaatacgcccaactgatacaccgataagcatagccaaaaaggtaagaggaattttccaaatagtttggctgaattcaactaatttggttttatagctactatgaggaagattaattgatgcaatcacttgtggaataccacttcctccaacatatggagtatattttttcgtaaaccaagtcaggcaagccatgcctatgattaggcagataaattctaaacttttgtgggaaattctgtatgtttgacgtaatttcttatggaaaaaatagcgtaagtgaaatttgagtggacataacatagtagtttatttgattaatgccaattaattaaaaattatagaagtgtcatttataaggagcaatgtatttattgttctaggaatcaaataaatgacttattatctaaaatctattaacttaataaatatttaaacgaattatcaaatatagaataaaaaaatgcggagaattttctccgcacttttctttttacttcttctgtcttttatctttaagacattcaagagttcatctattatttgatgattttcgcaacaacgcctgcacctactgtacggccaccttcacggattgcgaaacgtaagccttgatccatcgcgattgggtggattaagcttactgtcatcttgatgttatcccctggcattaccatttccacgccttctggtaattcgatagtaccagtcacgtctgttgtacggaaatagaattgtggacggtaacctttgaagaatggagtatgacgaccaccttcatcttttgataatacgtacacttctgattcgaagtcagtgtgtggtgtgattgaacctggtttcgctaatacttgaccacgttcgatttcttcacgtttggtaccacgtaataatgcaccgatgttttcacctgcacgaccttcgtcaagtaatttacggaacatttcaacaccagttacagtagttttcgctgtatctttgataccgacgatttctacttcatcacctgtacggatgataccacgttctacacgacctgttactacagtaccacgacctgagattgagaacacatcttcgattggaagaaggaacggttggtcaatcgcacgttctggttctggaatataagtatctaagtggtttgctaactcaaggattttttcttcccattctgctacgccgtttaacgcttgtaatgctgaaccacgtacgattggtgtatcgtcacctgggaagtcatattgagatagaagttcacgaacttccatttctactaattctaataactcttcgtcatctaccatgtcgcatttgtttaagaatacgatgatgtatggaacacctacttggcgacctaataagatgtgttcacgagtttgtggcataggaccatctgttgctgctactactaaaatagcaccatccatttgagccgcaccagtaatcatatttttaacatagtcggcgtgtcccggacagtctacgtgtgcgtagtggcgagtcggtgtatcgtattcaacgtgtgaagtgttgatggtaataccacgcgctttttcttctggcgcgttatcaatttggtcaaatgcacgcgctgcaccaccgtagtgttttgctaatacggttgtgattgctgctgttaaagttgttttaccgtggtcaacgtggccgattgtacccacgtttacgtgcggttttgtacgttcaaatttttctttagacattgctaatgtttcctaagaagtgcggtataaaacaatcatattttacaccgctggtttacaaaaattattttttacgcgcttcaattactgcagctgccacacttgttggagcttcagcatattttaacggttccattgagtatgatgcacgaccttgagtttgtgaacgtaaatctgttgcataaccgaacatctcagaaagtggaacttcagcatcgatcttaacaacaaactcgttcgcttcttgaccgttaaccatagcacgacgacggcttaaatcaccaattacatcaccaacatattcaggtggagtttcaacttcaactttcataattggctcaagtaatactgggtttgcttttgagaatgctgctttaaatgctaaagacgcagcaagtttaaatgctaactcagatgaatccacatcatggtatgaaccgaagtgtaaacgtacaccaagatcaactactgggtaaccagctaatggaccagatttaagttgttcttgaatacctttatcaacggctggaatgtattcaccaggaattacaccacctttgatttcgtttacaaattcataaccagggccttctggatctaatgggtataagtcgataacaacatgaccatattgaccgcgaccaccagattgtttagcatgtttaccttcgacatcattaacacgagtacggatagtttcacggtatgatacttgtggtttaccaatattagcttccactttgaactcacgtttcatacgatcaacaatgatatctaagtgcaactcacccataccagaaataatggtttcgccagattcttcatcagtgtgaacacggaatgaagggtcttcttgtgctaaacgacctaatgctaagcccattttttcttggtcagctttagtttttggttctaccgcaacagagattactggctctgggaattccatacgctcaaggatgattggtgcttcaattgcacataatgtatcaccagtagttacatcttttaagccgatagctgctgcgatatcacctgcacgaacttctttaatttcttcacgtttattagcgtgcatctgtacgatacgaccaaaacgttcacgtttttgacgtacagaattcaatactgtatctccagaattaataacaccagaatatacacggaagaatgttaagttacctacaaatgggtcagttgcaattttaaatgctaatgaagagaatggttcttcatcacttgcatgacgctcaccttcagtttcatctgggttgatacctttaattgcagggatatcagttggtgctggtaagtattcaacaactgcgtcaagcattgcttgaacacctttgtttttgaacgcagaaccacaggttaccaaaataatttcatttgctaatacgcgctgacgtaatgctgacttaatttcttcttcagttaagtcttcgccacctaagtatttttccattaattcttctgacgcttcagctgccgcttcaacaagattttgacgccattcttcacagtctgcttgcatatttgcaggcacttcttcataagtgaaagtcataccttggtctgcttcattccagttgatcgctttcattttgatcaaatcaactacaccagtgaagttttcttctgcaccaattggaagttgaagtggaaccgcattagcacctaagcgggtttttaattgttcaacaacacgtaagaagttcgcaccagtacggtccattttatttacgaacgcaatacgtggaacttcatacttgttagcttgacgccatacggtttcagattgtggttgaacaccaccaaccgcacagtaaaccattactgcgccatcaagaacacgcatagaacgttctacttcaacagtaaagtccacgtgtcccggagtatcgataacattgatacgatgttgtgggaattgttgtgacataccagaccagaatgcagttgttgccgcagaggtaatggtaataccacgctcttgttcttgttccatccagtccatcgttgctgcaccatcgtgcacttcaccgattttgtggctaacaccagtatagaataagatacgctcagtagtagtggttttacccgcatcaatgtgcgcactgataccgatattacgatatctttcaataggggttgtacgagccattattataaccttgtttatttaatatcagtttatataagggtaaggcttcatcaatgatgaagccctttaaattcaaaaacttattaccaacggtagtgagcaaatgctttgttagcttcagccatgcggtgaacgtcttcacgttttttaactgctgcacctttattatctgaagcatcagataattcgtttgcaaggcgtaaagccattgatttgtcaccacgtttacgtgctgcttcaacgatccaacgcatacctaatgcgttacgacgtactggacgcacttcaactggtacttggtaagtagaaccaccaacacgacgagatttaacctcaacagttggacgtacgttttcaagtgcaacttcaaacgcttctaaaggctctttacctgtgcgttgtgctaaagtttctaaagcaccataaacgattgattcagcaacggattttttaccgtctaccatgattacattaataaattttgcaagtaattctgaaccgaacttcggatctggaagaatcttgcgtgcttcaacactacgacgacgtggcattgcgaatttctccgtattttaatcttcaggatatccaaaacccatcagcaatatttctcattgagaaaatttgcagcgcaaagcgcttttgactggagtttatggtttaaattgttttgctaatttagacgtttggccttacttaacggagaaccattaagctttaggacgtttaacgccgtatttagaacgaccttgtttacgatctttaacgcctgcacagtctaatgcaccgcgtactgtgtggtaacgcacacccggtaagtctttaacacgaccaccacggattaatacaacactgtgctcttgaaggttgtgaccttcaccaccaatataagaagttacttcaaaaccgttagttaagcggatacgacatactttacgtaacgctgagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaataatagaatgttgttcaaaaaatctacttccatatagaaatagacggcgaattttaatagttttacgctttattgtcaataattaaacaatatactctaggcttaaaactagattaaaatttaccgcacttttgttttttaataaaaaactttattccccacgttttagcatgccttgttttttcaaattaaccagaataattgaaatagcagcaggcgttatacctgaaattcggctcgcttgtccaatggaaaccggacgatgttgttctaacttcgcacgtacttcattagataatccagacactttactataatcaaaattagcaggaatagccgtattttcatggcgtttttgtttttcaatttcttcttgttgatgctcaatatagccttgatacttaatagcaatttccacttgttctacggcttctctatcttctattgcgggcttgtatggcgttaaagaagtcaaaatatcgtaggtcatttctggacggcgtaataaatcttcaccgctggcttcacgcacaagtggactgccaagcactttattggcttcttctaaatattcagaacgcggatgcagccaaatgctgcgtaagcgctggcgttcttgctcaatcttttccattttttgattaaagcgtgcccagcgagcctcatcaatcaaacctaattcatgggcaattggcgttaaacgaatatctgcattgtcttcacgtaataacaaacggtattcagcacgagaagtgaatacacgatacggttctttcgtaccgagcgtacaaaggtcatcaaccaatactccagtataagattgatcacgacgtggataccatgcctctttctcttgtacataaagacctgcgttaatccccgccaataagccttgtgccgctgcttcttcataaccggttgtaccgttaatttggcctgcgaagaataaacctgaaatagcttttgtttctaacgttggttttaaatcacgtggatcaaaataatcatattcaatggcataacccggtttaatgatgcgagctttttccaaacctttcatggaattcacaatgcccatttgtacgtcaaacggcaaactggtagaaatcccatttggatacacttcgttactggttaatccttctggttccaaatagatttgatgtgaattacgatccgcaaaacgcatcactttatcttcaatagatgggcaataacgtggaccgatcccttcaattacaccagtatacattggactacgatccaaattattacggattacttcatgagtttgttcattggtgtgagtaatataacaaggaatttgttgcgggtgatcagataccgatcccataaaagaaaatacaggtaacaccgcatcaccatgctgtttagctaaaatatcaaaattgatcgtgcgtgcatcaatacgtggtggtgtacctgttttaaggcgatctacacgtaatccgagatctcttaatcgatatgaaagatttacagaagcaggatctccagcacgaccaccttcataattttccaaaccaatatgaattttaccggctaagaaagtacctgcagttaataccactgatttagcacgaaaaattaatcccatttttgtgctaacgcctgtaactcgatcttgctcaattagaatatctgtcgcttcttgttggaaaatatctaaattaggttgattttctaatgctgtacgaacagcttgacgatataaaactctgtcagcttgagctcgagtagcacgtactgctggacctttactactatttaaagtacgaaattgaattcctgctttatctgcagcatgcgccatcaaaccacccatagcatctacttcttttactaaatgacctttaccgatcccaccaattgcaggattacaagacatttgccctaaagtatctacattatgtgttaataaaagggtttttaatcccattcgagctggtgcaagcgcagcttctgtacccgcatggccaccaccgatcacaatcacatcataagtttcagtgtaaaacatatctatctctatttattcggatcaaaaaattggcgttattctacagaaatttaaaacacctgacaaaaaaagaatggatctattgatcctttgaaagatcaggtttgtattagtaaataagatctctttttttatatataaagatcttattattgttactattaagatcctttgtaattgtgagtaaacttattagatccttacggaaactggtgttataggatctaaagatcttgtgaaaatgcgatcattttctttaaaaatcttgtgtgtaaaatggaaagttattaacaactttattttttctcaaagttatcaagtgagtaaaaacagttttatgacagattatttatgagttatccacagataaaaatgaatttttattgaaatctctataatttagctttttttaaataattaattttattaaatgtaagttttatgatttgactttgtagttactacaggttttatgcttctttcaaatcaaatagttaaggaaataaaatgaaagaagtttctctagtaaaaaattatactcctaaagaatatcagcagcatgcatcttgccctcatagtcaaatttctaaaaataaaatggtattaggcatcagttttgcaattattaccttttatatggttgttgaatttctagggggatattggtttaacagccttactttgatggctgatgctgggcatatggcaaatgatagtttatctatttttttagcatggattgggttatttttaagtctaaaatggcaaaaatggttagctttaatcaatggaatttcattagtttgggtcgctatttggatttttattgaggctgtaacacgttggcaggctccgatagaaatagccgctttgccaatgttaggtgtagctttactagggtttgggattaatttgttggtagcttttataatgctaaaaagtaatcgccataatttgaatattcgtgcagcatatttgcatgttttagtagatttatttggttcggttgttgctattattgcaggaataagtgcttggtggttaaattggcagtgggttgatgtagttgctagtggtatcttaagcatttttgtattacaaagcggtatttctacagtttttcaagctattaaatccttatatagtagcgatgacaattcattgccgaatgatcattctcattaaagtaaaaaattgcttgaggaaataatgaaaattaatgaattaagtaaatctacacatactaatattgaaactattcgctactatgagaaacaaggagtattacctccacctaagcgattggctaatggttatcgattttatgatgaagagagtatagagcaattaaactttattaaaaaatgtcgaatgttgggcttctctttagagaatattcgggaactcaatcgtattagatttagtacgaaagatcattatcaagcagatcaattagtacttaatcagcttattcaagtagaaaataaaatatctcaattattagaaattaaagcttttttgcagtctattgttaccgaaaatgaacataatgaagaagaatgtaaagcaatagaagggttgaaaagcgaatgcaatttgtaaaagaaagaagatagattcatgaaaatacttaaaaatttgaccgcactttagaagaaaaaatgccatctaaattttagatatttaggcggcattttatttttctaattattacttagataaatcaatttggtatacagcaaatccaacttcatctgtacccacttgtttcattggatactgtgctttttctttgatgaattgagctgcttgttcgcttggtgaggtttcaaaacggacatctaatttatcgttacctgagataggcacaaaacgccagtttttatccgcgctagggtttacagaaccttctttttcactggttactttaatgtaatcagctaaaatttgacggttttcatctggtgatgcgtaaacaatatgttgatcgccagtgcctgggaatttattaccgtaagcacgatagttattcgttgcaatcaagaattctgcttttggatcaaccggtttgccttgataagtgagattcactacacgatgcgattctgggttaatcaatttacattcaccatcataacgtgcaggtttagttagatcatattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgttgctttaacaacgactaatgtatttggatagagatataagtctgccgcattacggaaagttaattcacctttatttacttcggtataacctgtagggtcatttttacgaccaccagctttaaatggcgctcctgcacttaaaataggtaagccagccattgctgcaacatttggtgcaactttttctacatacgctttttgtgcttggttcactatttggatggttggatcatcttgcactaatgcaagatagctgtacatattgtctgtggctttaccaataggttgagaaacaaacttacgtgtagcttcgtgaactggttttaaaagtgcggtaatttctgggtcattttctgcaagcacttttttatttttagcatcatagattggacgaagtactgcttttccagaggtaacaatccatttgcctttgtgttctgttaagcctaaatccaccacgctgatattatttgcccagtaaccagccatactttctggtacgccttttacggtaccatttacgatgtctgcatttggtgatttcgcaaattctttatttgggaataaacggtgtgagtgaccaaaaataacggcgtcaatatgtggtacatcagctagatagaatgctgagttttcagcaccttcttgataaggttcatcagatgggcctgtgtgagctaatgcaacgataatatcagccccttttttcttcatttcagggacatatttttgcgctgtttttacaatatcatgggtttccactttaccttgaaggttcgctttatcccaaaccataatttgcggtggcacaaagccgatgtaaccaatttttaatttatgtgttttgccattattatccaccacagatttttcttgaatgacataaggtgtgaaataaggttcttctgtccccgcttttactacgttcgcattcacaatttggaatttagcttgtttgatggcatctgcaagataattgagaccatagttaaattcgtggttacctaatgtacccacttcataattcatcgcatttaaacaatcgaccgcagggttagatttaccctctttatagccttgtgcagcttgatagtctgcaattggattaccttgaattaggtcaccgttatctactaatacactatttttcacttcagcacgtgcttgacgaataaggcttgctgcacgagtaaaaccgaatttatcggttggtgcatctttataatagtcaaaatcggtcaagaagctatgaacatctgttgttgccacaatgcgtaaatcaacatcgctctttccttttgccatcgcaaaacggtttgcacttaacgctaggatgctagttgctccaatttgaataaaatgacgtctattaatcattgagttttccttataaggtgggtaaatattgcctttattctaagaaaaatagcggattcttaaaagaaaggagtaaaaatatttttatttaattaagataataatttctgtactaaggaagtataaatattaaccccagtaagtaattgattttcatcaaaatcaaattcagcttcgtgatgacctgctgtgcgatctgcgccaagaatgaagtaaatagctttgcctccatgttcttgtacacgtctacctaaaatagtcgcatcttcacttgcattgaaagcataatctgaatttacgttatttatttgtggttgtttaagagatatttcttcgatgagttttataagttcaacatcgttattcatatccactgcttcacctacaatttcagtttcatatgcgacatcaaaacttatggagatacctttggctatttgcatgacttgttcagtcatgtattcattaattgctttattttctccccgcacttctaattgtaattcagcagaggatggaatgacatttcgtccttcacccgcttttagcacacccacattaattcttgtcatgccttcaccatggcgtgcaataccatgaagttgagtgactgtatgcgctgcagctaataaagcattacgacctaaatggggcgcagcacctgcgtgcgcaggtttacctttatagcgaatatcaatttttgtagtggaaagaaaatttcttggattagcaataacagtgcctgtatttgcgcaaaaactaatgtgtgaagaagcaaaataatctgcatcatcaattatgccactttgtgcaatggcagctgcaccacgaacaccttcttctgctggttgaaatacaatttttacttttccagtgagtttatctttgttctgagcgatccataatgcaacacctaaacctattgtaatgtgtgaatcatgtccacaagcatgcataaaaccatcgttaattgaggcaaaaccttctttatttggaatatgctctggtgagcgagtttccgttacattcacacagtctatgtcaaaacgtaatgcaatagttttccctggtttacctgaatcaaataatgccacacaaccagtgtacccttccattttttcgagccatttttcattggctccataggcttttgcattagctaagcctttatctactacggcttgttttcgtccacgaacaaagtctggatttataatttgtttgccaagaaaaatttcaaaacaatctaagtcttccaagtaatccgcaatgcgagaagttgtccaaaattcactccagccaatttctggaaaacgatgaaattcacgacgccatttaacaagttgatttaaatctaagttcatttttttcttcttttaaaagtctataaaaacagaccgcacttaaataaagtgcggtcaattttttactatttctacaacataaataatgctaagaataaaacagcaagtatcatgcctggtgcggtacgttttaccatttctactgggcttaccatcgcaaggcctgcacaaacaatagttacgcctgcaattggtgaagctgtacgaccaattgcaccagcaatggctgctgccataccaagatttatatgggtgtagccgagttctacagcatgtggcgtgacggcagtgttaaaggcaatcgctgctgcatcgccagagcctgtaattaagcccattaagaatggtccaattgttgcaccccaacgtacaaattcgttggattcttttaagaaagaaattgcagcatccactgcgcccgtagattttaatcctgccacaaatacactggctgcaatgataataccaagtacgtttgcataagaatttcccataccattgaaaaattcttcagtgatttttactggggaaatacgagtgacgataatgccgtaaattgcaccaattagcatcgcttgaggaacgcccattttagtccattcaagacccggtacttgttgtaatgatgttccaccaatcactaaaataactaatggtattaatggtgcaagggcataaagtacattgacgccttcaacaactttaatttcactttctttttgttctgcaagataagcttggcgatgttgttcaccataatctttaaaaacaagcgcaagaatggttaaaacaacagcacctattgctcccgcaatcatgttatatggagcatgtgaaaggtttacttgagtgatagttaatcctgacatttcactaatcattgctgagtgagaagaacccggactcatcattgatccaaaagtccctgctaaaatagctgcaccagcagtagctggtcgaacacccgcactttttaaaacgggaattaatgttgcgccaaccgcagcagcacaaccagcagcagaaggaatagcaatattgatgaaaaaggtaatgactgttgcaattggaattaagaagaattttaatccgcttaatggtttggtaagtaaatgcactagatgagtatcacattgagtgtatttcattacataagcaaaacccatactagaacagatagccataattaatccgccagatgtcatgcttttggcaaaagcatctaatgcacccattggattaagcgttagaatggacattattaaaccgacaccaatcaaaacggttcgggtttcggcttttttaatcagaaaataaattgtggcaataatgccaatcactgcaacgatggatttaaataattccattatatgttccctttaagttaataagaaaaagttgtattgatatcaaatgtgccacattccatattttcactgaagcacaaaataggattttcgcccaatacagttgccatttcattttgtatatgaagcgcagaaccttcaggtaatgcatatacaagtgcggttggattaacgagtaaaaattctgccaaacgttcttctcggctttcaccattgtggccttgcattttacctgaaataaagtgcggattaatttgatgaggaaaaagttgtaatgcttgaaatgaaggaggataagtaatcggcatatcattagttgtcataatagatgcgccagctacatttgccccagcactccaaccaaaataaggcgtaccgttatttactttttcacgaatgatatcaatcaaattgtgttcataaagctgttttaacaaacaaaatgtatttccaccgccaatagagatgacatctgcttgttcaataatatcccgatgctgtttaccatgatgaacggaaacaatattcatccctaaatcggaaagtgcattttgcacagttttttcatattcatcaaaagtgcggcttaccccagcataaggtacaaaagcaattgttttaccacgataatcagccaagaaattttgtaaccaaggtagggtgtgttcaagataacctgtgttcttgtattttgagctactgagcagtaacatatttttcatatttataatcctttttagggatgaaaagttattgctattatgcctaagctaaaaacaaaatccagcataaaagctggatttttatggattgcgtagcattattgatttagttgaaaacgatgcttttcaggaattaaaaatgacaaaagccaccttttaggtggccttgtctcaatattgtagggggggatgataatgctatcagtgaccaacgttccctatcgtcggggcggagtctatggttaaataattcaaatgtcaagtgataagtaggattatatgttatcagcaacgcaatttcttgttttagaaaaagcacttagtaaggaaagattatctacatacaaaaactatgtgaaaaataaaacttcagaaagtattaatgataacatggttgctttatatgaatggaattctgaaatagcgggctattttcttgaattatgtaatatatatgagatttcattaagaaatgctatttatagatcaatagattcgtatgatcattatggtatcagacagagacaaatacttagacaaagtcctaaattaagagaaaaagttgaagaattaggtagaaatgcgactgatggaaaaatcatatctagtttacattttcacttttgggaattttttgaagaagtttttcttgtggaattctcgtgagcttcacagaatgcctcttttgtatgcttatagaataatttcttttgaaaactcaaataaagataaggatatattatttattataaaagtcacaaagaatttaagagtgaacataagaaacagaatttgtcatcacgatcccatcttcaataaagatttaaagaaaattctgaaacaagttatgtgggtatttagtaaaattgattatgatttatacttagttattaacaatctatattccaataaaattatcaatcttttaaataagaagccaatctgactacaaatgtagaagatcaaacctcatctgacaaatcacaataaaaaatgagcatttcctgtttagtatatgagtgtcaaactcaatctaaacaggaaatgctcgtattttatttttacaacaggttagaattcaaactgaactgacattctatagtttttgcctggagcatagaaacgattaatacctgcacctgtttcttgattaatcaaattacttgtaccaaacatacgaattgaacgagcagaatcccaagtcatatattttttgtcaaataaattgtaaacacccgctcgtaaagttaaattcttcataggtttcacgaagaaagtaaaatctgtcactgtgtaagctttactacgccatttaatatgtttattttgaacatattctttatctcctgctgtagcatcttttgaataaatgttatatgtgtcactcgcttctttttgggaaacatgagtaagatataaatttgccccaaacagattatcaggatgcgtataggctaaactcatcacttgtgtcattggctgaatagcattaagtgggcggttatcgcttgctttacctttttgtttagttaattggtaaccaaaatcaacattcttcaaccatgatatccattttcctaatgtaaatttggttttcaattcaaatcctgtcactttagcattatctaaattaacagattgatataattcatgcttagttgcttgagaaccaaatgattttgttcctagataactaaaatcaataaaattattataatttgtgatgaaatatccaccagaaataaaaccgatttcatcatcatgtaaagttaatgataattccttagtttttgcaatttcaggttttaatttagagcctggaagaacagtaaattctgggtgcttgaatgtgaagtataattcatcagctgttggtgctctgaaacctttgctatattttgcttgaacttgtaaccaatccaatggatcgaattttgtgcttaaagcataagaactcgcattaaattttttgggttgagaaatataattaatattagcttctgcattttttcgtcgattaatttcatttggatcattagggtttagactccgtgtgttttttacaaaaggttcttttataaataaattaactaacatatcatcagggatttttggcgttatacccggttgataattggttttgtatttgactttgtcatatcgataaccgatatctaagccaagacgatcatttactctaaattcatctttaaaatagagagaaccatcttttgtttctacaggaataagaaatgatgctgtactattttttgtacataaatctgatgtactagattcacagtcttttggataatcaatccaccattttccactattaacttttaacccttctttatttatcattgattttgttgttttactccaaactaaaccataagataaatcatgttggctttttcctagttcaaaatgttttgttaaatccaaattaatttgttgagtacgagtatcaaggtcacgttttttccaaatgtttctattataaccaggtgaattaggtactagaaaacgagatgctttctctgggccaatattgtagccattttgatctgaaattttttcaataagtgcaaattttttaccttcttttgggattatttttattggtaaatccttaggcgttccatcagcttcgaaaccttgaattgtacctttatcacagttaattccatcacaagataataaattatcactattcgtgagccttgagttaataaaatactccttttttaaatcataagtgatgttattagctactaatgtttccttttcctcttttacatcagatcttagtctacacatcccctcgtgattagcatcaccgtgatttttaaagcagcgaggcgagtcaatataatattttccaccatattctttaagtttccattccttagcgagttctacaggaacttcttctttaaagttactgtatcgattaaagatagattcatcaatgtaagaatagtatgttacagaacgattttctaatttataggttacaggattattatttttatcaacaagtttattatcgttgttataatgtagtcctatggggttttgtaccccaggacaccgttcaccatcacaatgttcgtcacttcttgctcgttgagtaatactttgatctgtataagagagttttagggtatcccaaagtgggtttatatttgtattttcaaatgctatagatttactggttctaatgctttcatcatgagtatggcgagtatctatttcattatcatcacaaacatatttcgtgcatccatgtaatgagtaagatttgtctagacctttattttcaacccgtcttctatcataggctacggcaatgcgattattttcaccaagatttgtaccaattttcaataaaagactgcggtcttttttattataaggatcggtcttttctctgagttttcctagaatgtcgtctgcagatttgtaatcataatttttgatttcatgaccattacgccaagtgccgacagcaagtacatcgaatatacttgcttttcctgcaaaagtaatagaatttaatctttcatcattctcgctggtaaaaccagttttatatttaaacgcgtagtttttgttaagcagaagatctcttgcatctttagttttatagatgacggagccacccaatgcaccactaccagacatgagagaatctgcacctttggtaattttggcatcagataaagtttcaatttcaattccattacgcgtgttattaaaattaccatatccttcaaacaggtctttaaaaccttgggaagataatgtttctgcttgagcaacgccatcaaccgtaattgcaacacgattttcatctacccctctaatcgcaaaaccgctttgaccaaaacgcccagcttcaacaacagtaacgccagtctcgtatttaacgatgtctttaatgttgtttgcttgttctctttctagcgttttagccgtttttacagtttcggcaatttttggcggagttttcgtatcagtattttcggtagagccagatacatttatttgttctagttgttcagaagcattactattttggttggttggttggttggttggttggttggttggttggttggttggttggttggttggttggttggctctgcataagcaacacttgccgttagcccaagcataacggaataggcaagcacgtttaatctaaaattggtcatatttaatcctataaaaaaataataataattctcaaatatattatacgaggaagcattttctcacaacaataaagattgatttttgataaaaatcaagaaataaaaactattcttattattttctgtatttaaacctgcttgtttcctataatgcgagccgttgattgttgattagtagttgtagagtgggctttagcccaccaacaaacaatcgtgatattttggtgggctttagcccaccctacattaagtacgcatcattctatgcgtgcttctttttattttaggagcaatcattatgatgattttataaaggcaattcagttgttgatttgaccgtttttagagtaacttctgattttaaggttttaatgccaagcctagaattaagataggtatttttgactaattaaacactatataaagatacttgtactaccaataaaatggaaccaattagcaataagcatccaatcattggcatgacgaatttaacccatctatcaaatggaatatgcaacatttggagtgtcaccaaaactaatcctgtcggtgccaagaatagcattgcatattgtccccagttgtaagctgaaaccacgatatcgcgtggaatacccactgagtcagcaagtggcgccataattggcattgaaagtacggctaagccagaagaagacggcactattaaacctaggaaaataaatacgactaattggcctaagataaatacgctacccggcataccactaaccacattagacatataatcaaggatagtgtcagaaatcataccttgttcgagcactaagttcacgccacgagcaagaccgatgattaaggatacgcctactaattctgatgcaccttcagtgaaagattccacaacatctttttcagacaagccactaataaacataatgatgatagtaatggcaaggaaagatgcagccatttgagggaaccaccatccgccaaccattacaccccaaatcataatagggaatgagatgcagaaaagcgttaagattaatttgcgacgagctgagaatgggatagttgtgtttggatcaaagtttttcatataacgttgacggaattcttcgcgatcgtcgtaagtataagaaaagcttgggtcagctttgatttttttacagtaccaataaagatatgcgattacgcaagttgcccctaaaactaaacctagagcacggaaaccaataccttcagtaaattgaataccagccgcatttgatgcgataacaacggagaatgggttaattgtagagaatgcagttcccatagatgcagcaaggaatatagcccctacgcagactatcgcatcatatcccagagccaagaatactggcaccagaatcgggtaaaatgccactgcttcttcttcgataccacaggttgtgccgcctaacaccattaagacggatacgcagaatacaataaaaaactcattgcctttggttttcttcacgagagccatcaaaccagcattaaaagaaccagtacggttaatgacaccaatcataccacctaatacaaagataaagaccataacatcaacggcttcaatggtaccttctaccatacttttggtgatatcttcaatgcctttatggtgttgttctacacgttgataagtgccaggaatagcgattggttttttgatcacgccttcggtgaagttggagagtttaattttgatattgagattatcaagagtgtctgttgtggcgggataagttttatcatcaacgccataagctttgacgacaaaaacattatcagtagagttatatgttaattttgaatatgaaccggatggaataacccaggttaatccaacagcgagaattaagattgcaaataaaattgtaaacgctgatgggaaattaaacgttttcttctttttggacgcatccatagcgagttccttatgtttaacgtttaaagtgcggttggtaaaacattggttaaaccaaccgcactttttaccttgagaatggcttcccaaagttcctttattatttaagcataataggatatgccttcagcttttttcgtaatacgagtaccagctttgcctttcacaatgtccacaatatcagataaagatcctattactgcatcttttcctgtttgtttcgcaaagttgatcgcggcttgtactttcggccccatggaacctgaagcgaaaccaagttctgaaatggcttcaggtgaggcaactgaaattgctttttgattaggtttaccccaatctacgaaagttgcggaaacatcagttgcgatgatgaataaatcagcgtcaagattttctgcaagtaaagctgaacataaatctttgtcgataacggcttcaacaccttgtaaattatggtgttcatcataataggttggaatgccaccgccccccgcacaaattacgatactgcctttttcaagcaaccatttgaccggacgaatttcaaaaatacgttttggtaatgggcttggcacaacgcgacgatatttatcaccatcttgtgcgatagaccaatttttttcttttgccaaacgttcagcttcttcttttgtataaacaggacctattggcttagttggatttttgaaagctgggtcgttgatatcaacttctacttgagataataacgttgcaaatggcacttcaaatggaactaaattaccgagttcttgttgaatcatataaccaatcattccagctgtttctgctcccaatacatctaaaggataggttggcacatcagtataggcagcaccttgtaaggcgagcaaacccacttgtgggccattaccgtgtgctatcactaattcattatttggccaaatcttagcaatttgctcacaagcaatgcgaacattttgtcgttgattttcggctgtcattggttctccgcgtcgtaataatgcattaccgcctaatgcaatcactattctcatacgttctccttatgccaaacttgctaccattaccgctttaattgtgtgcatacggttttctgcttgttcaaatgcaatgttcattggcgattcaaatacctcttcagttacttcaataccattagctaattcaggatatttttcagcaatttgacgaccaactttggtttcgctgttatggaaggcaggtaggcagtgcataaatttcacttttggattaccagtgcgtttcattaattcaggtgtgacttgataaggaagtaataatttaatgcgttcgccccaggtttctaatggttcacccattgaaacccacacatcagtatggataaaatctacgcctttcaccgctttgtcgatatcttcagttacagtaatacgagctccactttctttcgcaaatttttcgcacatttccacaagatttgcttctggtaataatgctttaggtccacaaatacgaacatccatacctaattttgcaccaattaataaaagtgaattacccatgttattgcgagcatccccaatatatacatagctaatttcacttaatggtttgtcgcaatgttcaatcatggtaagtacgtcggcaagcatttgtgttgggtggaattcatcggttaaaccattgaatactggcactccagcataatcagccagttcttgaacgatactttgtttaaagccacgatattcaataccatcatacattctgcctaatacgcgggcggtatctttcatactttctttgtggccaatttgagaggaattagggtcgatgtaggtgacttgtgcgccttgatcataagcggcgacttcaaatgcacagcgtgtgcgggtggaggttttttcaaagatgagcgcgatatttttgccttttaatttttgttgttctgtgccggcatatttggctcgtttcaaatctcgggagagatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaaataatctaactctttattgttatttgtttgatttctaatagtagatgaatttaaacgaaaatatgttttagtttatttttgatgaagaggaatgtgtctatctatacttaataaaagtgcggttatttttattgcagtttttaatatattgatcttcagcaagtaccatttgtatatttagtgatatgataaacatagtttattttttgaggtttttatgaatttaccttttcgagcaatggtgtctgatttagatggcacgcttttaacacctgaacatttagtgggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtgggacagaaaaagtcttttttattggtaaaactccagaggatttagttgcagtagaaacttatttacgagataagtttggtgacgtaacgacaattgtttattcagcattagcttgtttggaagtaatgaataagaatgtttcaaaaggggatgcattaaaacatttactcgaatcacgcgagtatcagttaaaagactgtattgcttttggtgatggaatgaatgatgtagaaatgctttcttgggctggaacaggttgcattatgaaagatgctgatattcgtttaaaaatggcttgtccagagttagaagttattggctcaaataaagaagaatcagtcgctcgttatttgcgaaccctatttggattagattattaatgcaggcattattattcataagttatggtgcaatattaggcgcgtcattgcgttgggctataggattgttatttaatcctttattttcctcatttgcttttgggactttaatcgctaatttgcttggttgtttaattattggtgtattacttgggtttttttggcaatttccacaaattagttctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgttctcaacttttatcttaatcccattcactttggttttgcccaattaaatcagcaaattcatcgctacgaaatccgtgtgatagcatatattgccaaattttttgtttcattttagacgtttgctgttcgttataatttgggaattttttacgtaacaagttctcagccatttcataccaatcaatttctgattccattaaaacttcatcaataatatcagaagacacaccttttaattggcgtaattcttgtcgaattcttcctacaccacaacctttttgtgagcgtgaatttagataattttctgaaaaacgacgatcgctttgccaattttttgcttggcataaagataatgcatcatcaatttcttcttccgaaaagttcttttcctgcattttattgcggagctcgaattcactatattctctgcgggaaagaagattaactatgtaattaaaagcaagagatgacaaggatttattccttcattttattgaatcgatataaagtgcggtcatttttaaccgcacttttggcatttgtaattttctttattcaaaatcactttctgattcagtattattttcagattgttcaatatccgccattaaggcttgttctggattggccactaattcagcacgtaaacgagcttctaattcatctgatttctctatattttcgttaagccatttcattgaattagcctttccttgaccaattttttcgccattataggaataccatgcgcctgatttttctacaagtttgtgttttacaccaagttctaataattctcctgcttttgaaatgccttctccatagagaatttggaaatccacttggcggaacggtgccgctaatttgtttttcactacttttacgcgagtttcatttccaataatattttcgccatcttttacagaacctgtacggcgaatatctaagcgaacagaagaatagaattttaatgcattaccgcctgtggtggtttcaggattaccaaacatcacgcctattttcatacggatttggttaataaacacaactagacagtttgcatttttaatttgacctgtgagtttacgcaaagcttgagacattaaacgtgcttgcagacccatatgagaatcgcccatatcgccttcaatttcagcttttggtgtcagtgcggcaacggagtccacaataattacatcaattgcacctgagcgaactaatgcatcacagatttcaagtgcctgttccccattatctggttgagaaacaaaaagttcttttacatctacaccaagttttgctgcataaataggatcaagtgcgtgttctgcatcaataaatgcacaggtttttcctgctttttgcgcttgagcaatgacggaaagagttaatgttgttttacccgatgattcaggcccgaaaatttctacaattcgacccataggcaaaccaccaatcccaagcgcaacatctaacccaagtgatccagtagaaatagactctacatccaacgttttggtatcgcctaatttcataattgagcctttaccaaattgtttttcgatttgccctagtgcagccgctagggctttttgtttttcttcttgagttgccataattaaaatcctgtttgaatgttcaaatttttgtgattatatctgtattgatgtacaggtcaagaaaaatatttatattaataaaaaaatatggggtatatatttcagtaaagaggatggggaaggcttaaaataaaagtttttaacagagaattagattaaattatatacaaaaataatctcagaaaaagttttaaatatagtatatttatatataaaccaatcgtttagataaaaataaattttaaatttacgatctggctcacaaatctgacatttatatttaggtgtagtaaaaatttcatgatataaatgaaatcagaagtacttctactgactcttttaaaataattattcattggaggtttaatatgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcggaagctagaatgtacgttaagaaaattgaatcgattaaaggatttacccaatttaacgattaaacatgaaagagctttaataaaagttggtattacaaatgttgcgatgctaagagagattggcgcagaaaatgcattggtggaattaaagaaaagtggcagtggtgctacgcttgatttttattggaaattagtatgtgctttgcaaaataaaaatagtcagatgttaagtcaagctgaaaaagagcgtttattgaagaaattaaacgaagttttgagaaaaaatggcttaaaaggctatagaaaattagatgatgaataaaatttgttcattcaaataattttttgcaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttttaattttgaagtcttaataggtgcttaactgaaaattcatcattacttttttaagtagtgttttatttatagctaagtagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttagcaaatacataaatagaataaagcagagtagaataaaagataagaacccccagtcgaaaggctgggggtttttctatctttaaatttcaaaaaattagtaaaacagtatttgtgtttaccgattactcaatagcaatactgggcagagacggggatacctcttgtccttacaccagtaccttatttactaagatagaataaaaaataatcaatttactctcattataatgaacttaaagcaggagaaaagtgtatgcttatcccaatttttgaaaatggtaagaaaatatatcaagatagctctggtaataagtaccagtatgatttaaccaattcaatggatcaattctcttattctacagatctcagtgcacaaatgcgtgataaatcatctattacggcaacacgaaatccaaatggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttggtaagttattagttccatatcctaagatcaaatcaaatatgctgcaggttattttacatctgtcttagagggaattaaaaaagtctcccaaattcgaatattaatctaagccccatttggggcttttctacacattctttcttagctgtgctataatcccgctaaaattctacccttaaaaacaagagaaattatgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagctaaaacgtagggtgggctttagcccagcaatcatttcaaaaaacggtgggcttaagcccaccctacttcctttttcctatcaattaccataacgtaggacattatgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgcataatgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagcataaaggagagcgataatgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaattaaaattattaagatacgtatgaacttttttcacacacctgtgtctgagattgcagcaagagcttgctgtcttgaatattaaggcgtgttagatattggcataggagaaatatggctgaacagctaacagatcaggctttggtagaaagagtgcagcaaggggataagaaagccttcaatttgttggtttcgcgttatcagaataaagtggcggggcttttgactcgctatgtatcacgtaacgatattcctgatgtggtgcaagaatcctttataaaagcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggtacgcacttgcgggatgtggatacacccgaaaatgaaatgttgtctagtgagttagaaagaattgtttttgatactattcataacttaccagaagatttaaaaaccgcgattacgttacgagagctagaaggtttaagttacgaagagattgcagaaattatggattgtcctgttggtacggttcgttcccgaatcttccgagcaagggaaatgatcgaaaataaaattcaacctctaatgtagagcgaataaaaattggagtttactatgcaaaaagagcagctttcagcctatatggatggcgaacaagtcaaaactgacttgacagatgctttattaagagacgaagaattacaagcgtcttggcattcatttcataccgttcgttcagtaatgcgtaaagaaagtgcggtctttttagggggggattttaccgctaaaatggcagatttgattgagttagaagacgtgaagaaagtcgatgtcattgcggtgtctcaacctgaaccagaagatgcacataattctgcatttatgcaaaaattaaaggcattttttgcgccaatgacgcaagttgctgttgctgctggtgtatgtttagtggcagtacttggtgttcaatctttcaatagtaaaaacgaagcgtctaatttacctgaggctccagtattgcaaaccttgccatttaataatgcggttcaagaggttagctataatgcgccaagtaaagatacattgacttcagatcagcttgagaaaaaaagtcgtcgtattggtgcaatgttgcaaaactatgaattgcaacgtcgtatgcactctgatgctagcagtcaagtaagataaattggtttcctttgttcagattattgattcaccacctaattgttatttagtgtggtgaatttttatcctttagatttctatgaaaaaaatcgcattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagcgcattatatagtgatggcttatttacttttacgttgtttgtctctaatgtaagctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataaaaagtgcggtaattttttacgatatttttatcaataactgattttgagttaggcattgactaagattcgcacgtttttacgtgcgaatttttattttcttaattttattaattctacttggtgattgtgacctttttttagaattagatttgctcgctcacgagttggaagaatattttgattaaggtttaacccgttaatttcatcccaaattttactagcggtggtaatggattcttctttcgataaattggcataatgtttaaagtaagaattaggatcgttgaatgcgctttcgcggaatttcagaaaccgtttgatataccattctttcaataatttttcttctgcatcaacataaatagagaaatcaacaaaatctgatacgaatgtttgattggttttattattacctgtttgaagtacattcaagccctctaaaataagaatgtcaggtttatttatcacattaaatttatcaggaataatatcataggttaaatgcgaatagattggtgcttccacctcagttttgccagatttcacatcagctaaaaaatgaataagtttgggcgtatcataagaaatagggaaaccttttttgtgtaaaagatgatctttttttagtttttctaatggatataaaaaaccatcagtagttataagatctactttgcgctccgctggccaatgggaaagaagtgattggagtattcgtgctgaagtgcttttccctaccgctacgctacctgcaatgctaatgatataaggtacttttgttttattacgccctaaaaaacggtgtaaaacagcttgtctgcgaaggttttcgtcaatgtaataattaattaaacgagctaatggtaaataaatcatactgacttcatccaaagatagctcttcattaaaacctaaaagcggtttaagatcttgttctgtaagttttagggggacagatttacgcaattctgcccattgtttgcggttaaaacttaaaaaaggggttagattcattgagatattattgagtcaaatagacaattggagaaaaatatacgctataaataaaaatttagcattcatttttcattaaatgtgcactaatttgattaaaaaatcacttttttgattgtgatttaaacgaataatcaaaaaaataaacttttttataaaaaatacttgtcagttaaagttttttccatataatacgcctcacttgcttacgacacgccgacttagctcagtaggtagagcaactgacttgtaatcagtaggtcatcagttcgattccgatagtcggcaccattctttcgtatcaagtattcatttagtgtggaggggttcccgagcggccaaagggggcagactgtaaatctgttggctcagccttcgaaggttcgaatccttctccctccaccatcttttagatggatcctgatgggacagacgaatttaggacttgcgggcatcgtataatggctattaccttagccttccaagctaatgatgcgggttcgattcccgctgcccgctccagacgctgatatagctcagttggtagagtgcacccttggtaagggtgaggtcggcggttcaaatccgcctatcagcaccagtcttataattcctcatccttatatcaatcagcaaataaatttattggttaatgtggtttaatttacccatcgataaccgtgtctatttagagggactatttcaatgtctaaagaaaaatttgaacgtacaaaaccgcacgtaaacgtgggtacaatcggccacgttgaccacggtaaaacaactttaacagcagcaattacaaccgtattagcaaaacattacggtggtgcagcgcgtgcatttgaccaaattgataacgcaccagaagaaaaagcgcgtggtattaccatcaacacttcacacgttgaatacgatacaccgactcgccactacgcacacgtagactgtccgggacacgccgactatgttaaaaatatgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaataattgatgaactcttgaatgtcttaaagataaaagacagaagaagtaaaaagaaaagtgcggagaaaattctccgcatttttttattctatatctgatactttgcttgagtatttactaaattatttgatttttatagtgatagctgtggtaaataattttcagtgattccaacaagttcttctattgatattaattttatcttgctactttgaggtaaaagtgcggtgagatttcttgctaaaatatcttgttttaatatcatgcaattccctttacatttggcaaaataatcaggatattttattgccaataacacaccgtcttgccatagtactaccgcatctttttctgtaatatatgaaaaatagtcatctagttcagttttgggataatctgattgagaaaatgtataaagcataatattccttagaaagtaaacaatttttctgcttgattaagcttttctagcaataaagagcggtcaattttttcacaagataggataagttctctattatctaatttaaatttctgcaaagacgctgtgcagataaagcgttgttctacatcatataaatctaataatttaaaggctctaatgaaatctttttgttgaatgatttcgggttgttggttatcgataagatttaatacgccatcatcgataaaaaatatcccaatatcattgggttcacaaaaagctgtcgcggcaagaattgcatctaagccttctcgtgaaatggatgtgccatgtggagatgtgcgaaataaaaaggctatcttcatagggttattactcgatctgcgtttaaacttgctgctataaattctccaagacctgcaattataaatccttctgcaagattgtagtgagctgtagttggtgtagttaagttatcaacaacacctcgtcgttgagatgctgcaacacataaatgtaaaggaacattgtgggtgatggaaaacatttgccaatgtttttgtaaattaacttcatcattggctggatacactaatgcatttccgttactcactccatcttggaagaaaaaaatctgtgagatttcgtgtccttttttgattaaggcatttgcaaattgataagctaaaaatgccccttgctttccgtaaatagggcttttgacggcgataacatagcgcattattcttgctcttgtttgatttgacggatgtacaggtaaaccgtatgtcgggaaatatctaaacgttcagcgactaaattaatcgcatctttaatatcaaaaatacctttttcgtaaagagaaaggacgatttgtcggtttttagtattattggcaacagcgcgatccgcattgacttcttctattgttttttcaatagtctgcgcaaccaagtcttccactgaattcgcaaagttcactgaagatgtttcattcgtatgctccgttggcataaagcattgcaaaaattgagacatgggtacatctaaattgatattgatgcaaagcaaaccaataatacgttgagttttattacgaatagcgatagtaactgatttcatcagtacgctgccttttgctcgtgtaaaataaggttttgaaacactttcgctttgcatatttcgtagcgaacgtaaggcaagatcagtaattggcgaaccaacttgtcgattagtgttatgtccgttggcaatacaaatagcagaatgttcaatattttccagagaatgaagcactatttcgcagtgctcgccaatcagtgcgctgacaccatcaacgactgctttgtaggaatttatgatagcttgatcttcatcagtgaaaggatatttatcgtttaatgtcatagcgttaggttaaaagtgcggtaaaaattccgctcgttttttataataaaaagcacgcgttaaagaacgcgcgctattaaacttatccgttatttttcagatttcggattgacgtctaatacttccacatcaaaaattaatgttgaatttggtggaatagatgcgccagcaccttgttcgccatagcctaattcaggtgcaataactaattgaatttttccgccttttttcactaattgaagaccttcagtccagcctttaattacttgatcaagttggaattctacaggttgtccgcgctcgacagagctatcaaatacttttccatttggtaatttacccgtgtaatgtactttaaccgtatccgttgatttgattgtatcgcctttacctgcactttcaattttatacattaaaccagattgcgtcgtttttacatctttccctttagcaaattcagcacggaatttatcgccttcttcttttgcttgtttagcaatcgcttctgcttttgcttttgatgcagccactaattttgcttcaatagattctaaggttttttggattttttcatctttacgaacatccactttgccttctaaagcatcttttaagccatctaaaatacgcgcattatcatatttaataacttctttgtgggaatcaacaagatctttcatttgactgcccatgagcgtacctactgcataagatgccgctttttcatcgaatgtgttatcttctgcaaaaacttgaccagaaattaccgcacttaccattaatgctgcgatagataatttttgaatttttaacatataagttaatcctttataatgaatggaataatacgaggaatagattaaatggctttctatctattctcaacttttttttagaatttagagaaaatttatgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattattgatttttgcaataaattcgtacaaatgaaaagggcgcttaatgcgccctttaaattacattctcaaataataatcagctaaatacttgcctgcttatgcaaagtatttttccaaatcgtcgctaccgccaatgtgtttaccaccgataaacacttgtggaacagtagcacgacctgaaactgcacgtacgctcacgattgttgcatcgtgacctaatatgatttcttcaaagcttaagcctttatcgtgtaaaagttgttttgcttttgcacagaaaggacagccaggttttgtaaagattgaaatagactcttgcacttggtgttgtggtgcaaggtatttcaacatagtgtcagcatcggatactttgaacggatcgcctggttcgtttggttcgataaacattttttcaactacgccgtttttcacaagcatagaataacgccatgaacgtttaccgaagcctaaatcttctttaccaactaacatacccatgccttcggtaaattcaccattaccatctggaatgaaagtgatgttttcagatttttcatcttctttccatgcgttcattacgaaagtatcatttacagatacaacaagaatatcgtctacaccgtattttttgaatactggcgctaattcgttgtaacgtggtaagtgtgatgatgagcaagttggagtgaatgcgcccggtaatgagaacacgatcactgttttgttatcaaataactctgaggtagttacatcaacccatttatcaccctgacgagtgcggaatgtcacttgagggactttttttccttccatactagacattgttttttctcctattggttgttaatttaaattttacgtgctgtattatagggaaaattatgatatagtcataatcaattaattctattcttttaattgaatttttctatagggaaaatctcatgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaataatggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgcgaaattaagcattttgttgatgagttagcagaatatatttcctacaaacatcaatattcgcaatatgttgcttatgttcaagcggaaggcatcgtaacaatcgtattcactgcaggggcgaatgctttagatatgagtaaagctgagcgtgagcaacttaaagctcgtgtgattttgcagttgagaatgcttgcaaaaggtgctgattttgcagcgaataaggaaagaggcaagtaagatagtttatatctagcctattagttttctctttgtgcttaggtatttgctatcttttattcttccaagttatttttcataccaaattttatttatataaagggtaataaatcctgatggcgtttctacccgcacttcgtcgtctaatgtttttccgattaaagctcgagcaactggggaatcaatggatatccaatttttcgcaggggcaaattcatcacaaccgacgatacggtattgcttaatttcaccttcttcattttctaattccacccacgcaccgaagaaaacttttccctcttgctttgggttgtaatcgacaatttgtagcacttccaatcttttagttaaaaaacgcacgcggcgatcaatttcacgtaaacgacgtttaccataaatatattcggcattttcgctacgatcgcctagcgcagctgcatctgaaacggcttgagtgacttttgggcgttcttctttccacaaaaacttgagttcttggtcaagcacaagccagccttgacgggtaatataatttgattttgccataataaaaataaaagaaagttttttgaattatatttgagccagcccactaaaaccagtattctatctttgtttttttataataaagaagtacgacaatgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaataacaagttatagggcgaaattattcgccctttttttatcgctttcctttcccgaaaagcatcgccaaaacggcgattttttgctataatctcgcccaatttttatttacaaaagaatgagataaattatgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagaatctcgtaaaggtcttgaagtacaacgttataaaggacttggggaaatgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtgtaaattttcgtctatttatattcaattcatgactgaaagggcaccaaagtgccctttctttgtttatcttgttatttcatataaggattactattggttttttgaacttaagtgagtaaactaaatgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgcataactgttattttaataaaatacgatcgtaatagaacagagaaaaacaatgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctttaagtttcttatctaacaaaaaagtgcggtgaaaattgatctgcaccccaaaagttggactaaccaaaccaacaattgaggggcagattttttatgggtaaacactacacaatcgaatttaaattacaggctctccaacctattttgaatggaaaaatgagtattagagaagcggctcgtttttacaatattccttccaacgccttagtcgggacatggttgaaacggtttgaaaaaagtggcataaatggactgattccccgtaaaccatcaggacgaccgccaatgaaacccaaatatgccagaatgccaccgccacccaaaactgaagaagaccgtttacgtttgagaattttacagcttgaagcggaggtagcctacctaaaggagttgagaaggctcagacttcaggaagaagccgagcaacagaaattatccaaaggttaagaacacgctatccgttaaaatggcttttaggctttgcacggttagcgcgtagtacgttttttgctaaacttcagattaaacgagataaggatgagccgctgaaaaaggccattaaacgcatcaaagccaatcatcctgattatggctaccgacgtgttcatgcctatttgccaggtgtgaatcatatcgtcgaatcttggctgaacatggcatcattcaaagtatgtcgagaaaagggaattgcttggacaatgcagcgatggaaagtttctttgggcgattaaaaacggaatgtttttatggttgggaatttaacagtagagaggagatagttgatgccgtcagggattatttgggttactataatcaccgacggattcaactaaaattaaaaggactgagtccgatacaatatcgaaaacaatcctttaaataacagtctaactttttgggggcagatcaaatctgttacttactattggtatttcagttaataaattatttggtgttgtccgtagttcctctggtaatgttgattgtttactcttatggaaacaagctaaattaaagtccattccaccaagagatttctcctgcttaaagtagttatttttttgataacgttcagaaataaaccaataacacttataaccaatcttatctaaataggatatcaactcattagagtgatgaatatgagcttctacaaaaattataggcttatgtctctctatgagattctttgcaccatttaaaacatttagctcaaatccttcagcatcaatttttaatagatctatatcttccaatcgattaacttctgggtgtttatctaaagaaataacatgtatcaattccttagattctacacctataaaattaccctcggtactaaaccctttatctaatgaaaaacttccataattccaagcagtatcataatttgatgagggaatctcaatcaactgttcattttcaccaacccccaaattataggcatgaacatttgttaattgattaagcgacaaattcgcacaaagtgtctgaaaaattactctttgaggttcaaaacaaaataatttccccccccccccacttattgtctttgcaataggaactgcgtgcattccaatattcgaaccaacttcaatgacattacttgaagaatttaggttttccaaaaaaaattggacttctacatctgaccattcgccataaagtgcagcatattggctaataaaatccccttcaataagattaaaggttccccactttaattgataaatagatgttttcataaataatattccttagatttaaattaccgatactataacaaaaacagaactctttgtacgataaaataaataaaggaattaatttttaatcatccgtacaaattactctatacaaattctccgtacgacttacgaatctcttatatgttatctttcaactgcactttttcatcgcattttgctgtatttcacggtaaaccatctcaagttttcagaaataataggtaatttatgcgtcttttcattggaattttagtgggtgtttaaaccattctctttggcagattttcgatggaaaatgcggcactttactttggtattgcgagtagtggaaccccttagtcaatggttgaaagcctttcggaaaaacggtataaatgggtgccatcccaaacctaaaggtcgcccaagtatgaaacccaaatacgctaaaatgtctccaccacccaaaacagaagaacgtttacgcctacgcatccttgagtgagaagcagaggttgcttttctaaaaaagttggacgaaataatcaagagggacgaagctaaacggcagaaacagtccaaagtttgagagtgcattatccttatagattaagtcgtcgcccaaatggcatgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaataacagtctaactttttggggtcagatcaatttttaccgcacttttgttatctacttaattgattttaaagaatgtttgaaaattcttctaacatttcttttggccatacgcttgattgcacttcaccgatatgttttttacgaagtaaaagcatcgctaagcgagattgaccgataccaccgccgatagttaatggcaatttcccgtttaataaatcttggtgccaatccatttttaaacggtcttcatcgcctgttaagccaacttgtaaacgtaatgcactttcatctacgcggatacccattgaggatagttcaaaggctttgcctaattggtcgttccataccaaaatgtcgccatttaagcctttgtagccattttcagattctgttgtccagtcatcatagtcaggtgcacgaccatcatgaggtttgccatctgaaagtttgccgccaatcccgattaagaatactgcaccgtattctttacaaattgcgttttcacgctctttactgcttaaatctggatagcgttttactaaatcttcgctatgcacaaaggtaatctgttttggaagaatggaaggaatatcaaaacgtgcttctacggctaattctgttaaacgaatagcacgataaatagaatttaccgtttcttttaagtatgcaaaattacgacgaccttcaggaatcactttttcccagtcccattgatctacataaacagagtgcgttggatcaagagaatcttcatcgggacgcaatgctttcatatgaacaaacaagccttcgtcttctttaaagttgaaacgagctaatgtatggcgtttccatttcgcaagagaatgcacaacttcaaatatggcatttggaatacatttcacattaacctgtacggctttttcaatgcctgataagttatcttgcattccgttacccacttggctcaaaattgggccttgcacttcaataatgccaagttgctcaataagattttgggtaaaagtgttcttcacaaagctgatttcttgttgttgtaaaataaatgtctttttcattttgataaccttttttaacgaggagtaatatttttgagtattattcagtaaataatgattttatttcaagtattttatttactttcttttcttggttaaatatcatctaattcattgtgaaaaaattaaataaaatctaaaggaggaagttttatgcacaacattgatagtttagatcaaaaaatattacgtgtactcactaaagatgcgagaacaccatacgcagaaatggctaaaaattttggtgttagtccaggaacgattcacgttcgggtcgaaaaaatgcgtcaatcgggcattattaaaggcacaaaagtaattattgatgaacgtaaattaggctatgatgtatgttgttttatcggcattattctaaaaagcgcaaaagattatgaaaaagtgatcaaaaagctagaaagttttgatgaagtagtcgaggcctattatacaacgggcaattactcgattttcttaaaggtgatgacacacacaattgcagaattacattccgttttggcgaccaagattcagttaattgatgaaattcaatccactgaaaccttgatttcaatgcaaaatccaattttgcgagatattaaaccttaagaacatagaaagtgcggtgaaatttttattcaaatttatcttggtgtttaaatttcaataaatctctccgctcttttttatttgggcgacgatcaggatggggcattgaaagggaattattttttcttgcccacgcgatttcttctctttttttcacgctactttcggtttcttgatagagtaattgtgcttctggcgcacctcggcgttgatcgcttaaggcgataatttttatttctttttcttcgtttccctggcgaagttttaacattgcgcccacttccacaattttacttactttcgcacgttgattgttgtaatgcactttaccactttcaatcatcgctttagcaatgctccgtgttttgtaaaatcgggcagcccacaaccatttatctaatctgacttctttttctgccattattttctccttattttgattcgacaaaatagtaccacaaagtatgctaatgaactgttattaaaaattttattctttaataggatttttattaaatgaaaaaaaataaaaacaggttaatttaaacatttttcaataaaacaaattttatgttaaaaaaacttgaaaaatagtcaaatttttgacaaggttgagtggttttctttttttaagctcaaggaacaatttatgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaaacaggaaaagcggcgttccaattaccaatgggcttttcacttgccttactcggtgctggttatttaattggtattgtcggcggtattgcgatgttaatcggtgttattttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatctgattaatccttaaatttattttagaataggttatcttctggataacctatttttcactatgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaataattttatgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaattgattggttcgattggtttttttctctagaatacggcattattttcgacattactcggaagccgaataaggaataattatgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgtggcagccgataaattaatcgcaaaacaaggcaaggtttggcgtaaaccaagtggattgatgaagaaaaaagtgtaacgatgatgacctagggtaggtttaccctaggctagcaagagtactacccctttggggtagaattaccgtttcccaaaatggaactactatcacgtaattagccgtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctctaatggaaattttagctcatattttaacttgcacttgtcacccttgaacatttctacattctctatttagaaatgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaagtaggagttgcctgcagtgttggcaaaattgatcgcttgtaggggcaaattacatttgccctataaaaacaattacagcggaatgtatgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagattaaaagggcgaatgtaataccctcctacaatttatctacatcatagacaaacatgtaggggctaattatattagccctcatcataaacaaagatttagtaatccaacaggagaaaacaatgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatcttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtgtagttaaaaacatcaataagaattaccgcactttaaactgttgccataaatttggatagtttattaatttgctgaaatattgggctctacataatgtagagctcaattatttatactaagggtatactttattgatggcagcgatcgtaaagcggttgtaattgttgaatggtgtgtgtaataaataaaatgggatctatttgatttaactcggctttttcaatacttttcccaatgcaccaaaaatcctcatctgaacgtaagatcagatttttttcagaaatgaccttcacttggcgaaaatcatcatattcactttcatcctctcgccaaatctcaaaatcagcaaattgtttgaaatcaaattgatcaagccactgattatattgttgcacattaatttgtgagcgatctgcacgatagcaatgccaatctaaacacactcttagtcggcgacgatttaatagcacagaaaagattgcggcagaattttggttaaactcgtatttaaaataagcgaagaaatgcgcccgtacctgccaaccattggtccagctttcaatatgcggtttcgcaaaaggcgtaccgagttgtgctgaaacagattgaattatcgctttccaattatcccaatgtaatttgtaatccgctttaatcgctggaatatcttctgggcagaattttttcatttgggcgaattgatagaaaggaatattgaacagttcacaagattcagcagtgagcgagagcatagcgtttccttaaaaatcactgtaatttttgaccgcactttgtgtgaagatctgcttgtcttcccagcgtaacatagtcattcgattattccacacacaaccagtatctagggcataaacaccttttggggtaggctcatccactaaacttgcccaatgtccaaagacaatgggaatttgtttataaagtggattacctaaattaaaccaaggcgtgagctctgtaggtgcatattttaaaggggatttacaggcaaaatccaagcgatgatctaaatagcaaaaacgcattcgagtaaaagcattaataatgtaacgatgacgcgctaagccctgtaaatcaggcgaccagcgatcaggttgttcggaatacatattttcaatgagataatgaaaatccccattttgtaaaatctgttccacttcagccgcacaagatttcgcagtttccaaattccaatcaggcgaaatacctgcatgcaccatcaggaagtttaactttttattatgtacaagtaatggctgatggcgtaaccaatgaatcagttcatcaaaatcgggcgcattaaaaatagcatcaacacgatcacgcggttttacttttttaatacccagtgcagtcgcaattaagtgtaaatcatgattgcctagcacggtttgtgccgaatcgccaagtgattttacgaaacgaaggcattcaagtgatttatccccacgagccacaagatctcccacaagataaagtttatcttgcgttggattgaagttcacacgttctaataaaagctgtaattcatcataacagccttgtaaatcaccaacgaaataggttgccatttttgaccgttcttttataaataaattttgagaattttaacacagacttttattgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatgtagaaagccaaggtgtaacaaggattacaccttttattatttttactcttctgaatctaatatttcatcgttattaacatctgctggtggattatctgccagccagttcgctaagcgcgcataatctgcgatagccaaattttctgcacgtgcatttaaatcaataccaagtgcggtcagattttcaggtgaaaatagtgttgaaagtgcattacgcaatgttttgcggcgttgattgaacgcttgggagcaaacacggttcaaccaatataaatcttttacagggtgcggcaattctttatgcggaattaaacgcacaacggctgaatccactttcggtgctggtttgaatgcagaaggaggtacttcaagtacaggcatcacttggcagaaatattgcgccataatggttaagcgaccataagctttgctatttggccctgcgcataagcgtttaaccacttctttttgcagcatgaagtgcatatcttgaatcacatcatgatacttaaataagtggaacattaatggcgtagaaatgttataaggcaagttaccaaatacacgtaatttttgccctttttctgctaaattctctgttgtataaagctcatcaaaatcaaattgcatcgcatctgtttcaataacggtgagcttttgatgtaaaaatggatggtgacgtaaacgttccgcaaggtctcggtcaagctctaccacagtcagatgatcgacaagttcaccaacaggctctgttaatgcgccaagtcccggaccaatttccactaagaattgattgggttgtgggtaaatcgccgccacgataccttgaattacagaagtatcatgtaaaaagttttgaccaaagcgtttacgcgccgtatggcctaagtgtttttttgaattcataagtactatttaataagaaaagtgcggttattatagagcctgtatttcttttgtaaattttagtgtaactgtcatgggtaatatcatttagcgatgagttccagtatagctttaatatgatgactcaaacttggattataacgaatacaatccattggattgagaatacggtgtagctgttcagatgcttgttttactgatttttgaattgcctcatctaaagtacttatgttttctctagaaaatgtatagccaaattcgttttttaatacttctaggcatcccatgttttcagaaaaaataactggcgtaccagataatatagattctagtccaacaagcccaaatggttcatattgagatgccataatagtgaaatctgccgcttgatataattcaggcatatttttgcaaaaaccaagtgaagaaattttaggattttcttctacaggcgttcctgcgaccactaagcgaataggtaactgagttttttcaaaatattttttcaaaatatcgaaaccttttcgcgtatggccagtagaagggaataggtaaatgatttcatcttttttgaaacctaacttttctctgagctttactctttcttcttcattgatttgtgtgaatttatctgtattaatagggggataaatcacatcaattttgttttcagagacatgatataactcaacgagttcttttttcattaatgcagaatgagcgatgacatatttggactgatttaaggatttttgttcacccatgattttaaatcgatctgatatgctgggctttttctttgatgcttgtaaatatcctttatgatttccaccacaaatgaccacgtcagatagggtgtaagaggttgtcagagagatttctgatgtttctttatatttatttgaaaaataggaaagaaacgaggttctccattttttaggaacaaaagaaagattaatcttaattggatataattagattatattcaggtaatgcagtatcaaacttggcagagtaaattttaggtgtaatgttagcctgagataatccattaacaatatcaataagatatcgttccatacctccaccgtattgaaatttttgacaggttaatgaaatatttgggtgattattattacttagtaatgttttattcatttgtatctacctagtaatggggttatttatgttgattatagggggtgttttgattttgtaaatcatttttcagttatgtcgaattgagttttttatgaacaatattattttttctttcgcagaaagctaaaaacggctataatccgcccgtttttcttaacttttccgcctaaagtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgttaattgcagaatatgtgagatagaccgatatatatcggtcttcttttttgctcaaaaagaactcaaactggttgcggaacgtaaaaaaatcggtataatccgcaacccttagccacattgaatttttcgttccttgcctttgcagattggtggctgatctacgtcaaaggctgattaacccgtaaggagcagtaatgcgtcactacgaaatcgtgtttatggttcatccggaccaaagcgagcaagtaccaggtatgatcgaacgttacaccggttctgtaaaagaagctggtggtcaagttcatcgcctagaagattggggtcgtcgtcaattagcgtacccaattaataaattacacaaagcacactatgtgcttatgaatgtagaagcgcctcaacaagtcatcgacgagctagaaacgactttccgttataacgatgctgtattacgcagtcttgttatccatactaagcacgccgtaacagaagcgtccccaatgaaagcggctaaagaagaacgtaaacctttagctgaagttgaaaacaacgattttgaggatgctgaagagtaatttgaaaattgataatcgtttttcggttatgggagtcgtttctcagttaccaaagcgattaaaaagccctagtggaattgagcattgcaagtttttgttagaacatcgttctgatcagattgagagtggttttacacgtcaagcttggttaaaaatgccagttcaaattagtggtaatcaattgatagaaaaaactcaaagcattacggtcggtagtaaaattttggtggtgggatttattacctcacataaaacccaaagtgggttatgccaattagttttacatgccgagcaaatcgaatttatagattaggagactagccaaatggcacgttatttccgtcgtcgtaagttctgccgtttcacagcggaaaatgttgttgaaatcgattacaaagatatcgctacattaaagaactatatttcagaaagcggcaaaattgtacctagccgtattaccggtactcgtgcgaagtaccaacgtcaattagctcgtgcaatcaaacgcgctcgctatttagcgttacttccatacactgacaatcatcagtaattaaggagacacggtaatgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataatttatccaatagataaaataaaacccagtttaaaactgggtttttttatttttatcatatataaatttagaatagggtaataaaaaatatcccttattttagtagatttgagccctaagtcatatagagctcaaattttctgttgggatagattttttactcgtataagcgaattacatcattccacccataccgcccattccagcagcacctaaatcggctttatcatcttttggaagatcagttaccatacattcagtggtaatcattaagcctgctacagaagctgcgaattgcaatgcagaacgagtgactttagttggatctaagatacccatttcgatcatatcgccgtattgttctgtacctgcgttataaccaaagtttccttctccatttttaaccgcacttgccacaacagatgcttcttcgcctgagttagtgacgatttgacgtaaaggtgcttccatcgcacgtaatgcaagtttgatacccacattttgttcttcgttgtcaccttttaggcttgctgcaactttcgctgctgcgcgaactaatgcaacgccaccaccggcaacgataccttcttcaaccgcagcacgagttgcatgtaatgcgtcatctacacggtcttttttctctttcatttcaacttcagttgctgcgcccactttgattacagccacgccgccagctaatttagcaacgcgttcttggagtttttctttgtcgtagtcagaagttgattcttcgatttgctgacgaatttgagccacacgacctttgatttgtgcttcatcgccgataccatcaataatggttgtgttatctttattgataacaacgcgttttgcttgacctaaatcttccaatgttgctttttcaagctccataccaatttcttcagaaatcacagtacccgctgttaaaattgcaatatcttgtaacatcgctttacgacgatcaccaaaacctggtgctttcactgctgcaactttcacgataccgcgcatagtgtttactactaaggttgcaagtgcttcgccttccacatcttcagcgatgattaataacggtttacctgctttcgctacaccttctaacacaggaagtaattcacgaatgttagagatttttttatctacaagaagaagatatggattatctaattcaaccgttgcagtttctggtttgttgatgaaatatggagaaaggtaaccacggtcgaattgcatgccttcaaccacatctaattcatcttcaagacccgtaccatcttcaacagtaattaccccttccttgcccactttttccatcgcttgtgagattaattgacccacaatgctgtcagagtttgcagaaatggtacctacttgttcaatttcttttgctgtttcacaaggtttagataaatttttaagttcagaaacaaccgcacttactgctttatcaataccacgttttaaatccattggattcatacctgcagctactgctttcaagccttcatttacgatagcttgcgcaagtacagttgcagtagttgtaccgtcacctgcagcatcatttgctttagatgccacttctttcaccatttgtgcccccatgttttcgaatttatcttctaattcgatttcacgagcaacagacacaccatctttagtgatagttggtgcgccaaatgatttatctaaaattacattacgacctttcgggccaagggttacttttactgcatccgctaatacattcacgcctttaagcatttttacgcgtgcatcgttaccaaattttacgtcttttgctgccattttcttttttccttaatttaaattattccacaatcgccaaaatatcgttttcagaaatgattaacacttcttcaccatcaattttttctgctttcacgccgtaaccgtcgttgaaaattacggtatcgccaactttaacatctaaaggttgaacggtgccattttctaaaatacgacctttacccacagctaatactttcgcgcgggttgatttagtcgctgctgaaccggttaatacgataccgccagctgaacgggtttcgacttcttcacgtttaataattacacgatcgtgtaaaggacgaatattcatgattaatttccttcttaagaatttgtaagtgcggtttctatataaggaggattttttttctttcaaggggcttacaaaaaattctgacaaaatatttttcctattttagattttttacgtaaaattcgctgactttcgtataataaattaaggaatgaaaatatgcacttaacttccagagaacaagaaaaactgatgcttttcctcgcgggcgaacttgcggcaaaacgcaaagcacgcggcgttaaattaaattatccagaaaccattgcttatattgcgagccatttacaagaggctgcaagagacggaatgagtgtagcggaagtgatgcaatatggcgcaacacttttaactgttgatgatgtcatggaaggtgtggcagaaatggttcatgaagtccagattgaagctactttccccgatggcacgaaacttgttaccgtgcataatccaatcagataaccgtagggtgggctttagcccaccaaaataaaaatatcaatggtgggctaaagcccaccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttgttggttaccaaatcatggagagtttccttattggtatcgcctaaacggattctttttcgtactatgccatatgtcgtctgttcatactgaactcagtacaaacagtctgaactcgtgcagatgacg

SEQ ID NO: 682 - DNA, 135356 bp, H. influenzae
  misc_feature (222)..(222): n is a, c, g, or t
  misc_feature (228)..(228): n is a, c, g, or t
  misc_feature (135317)..(135317): n is a, c, g, or t
  misc_feature (135320)..(135320): n is a, c, g, or t
  misc_feature (135328)..(135328): n is a, c, g, or t
ttccgattttttgtgccgtattccaaattgacacgatagtaccgcgttcagatttagcccaccaatgcaccatagtacgaccacatggaggccaacccataccttggaaccaaccatttaagaagatcattacccatataatggcaatgcctgaagttgcccatgggaataaacccattaaggtcatacataaaccagagagcaataaaccaaatggtaagnatacantccgatattatgtgccgtattcccaaaatgtaagaaaaaataatataaaaagtgtaatcattgtagagaagtgcggcaaaattaacaacattttgagtgtaaaagaaagcgattttgtgatattgatcacaataattttcgcattcgctcaaacggtgtaaagatttgtgaaacacttcacatttttgattttttttactttcttatttttttattttcttttatgattcgcaaatcccttactgtttcaaaagggtaaatttagatgacacataattaaaaagttggagaaaaaattatgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataattagcttaaaaaaggcggtgggcaaattgcttagtcgccttttttgtaactaaaatctaaaaactctataaaaatttaccgcactcttaaggagaaaatacttatgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacaaccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataatttataaattaattctcatacaaaaagagcggtcaaaacttcttttattttgaccgctcttttattctgtatctgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgcgcagtattacccgtatcaactaaatcatctaccacgataaatccttcgccaccatttggcacttgggctgcatgaagaacttgtagttctccctggttgttatgatcgtgataacttgcgatacaaacggtttcaatatgacgaagacccaattcacgagccaatacagccgctggaaataaaccaccgcgactcaccgcaataatacctttccattgagaagctggaagtaaacgttctgataattttcgggcatgcatttgaaacatatcccaagttaccacatatttttcgctcataattgcaccttagtttaaattttgcataaagatgcactacccgcgtttttcacagacgtaaatcaaatgtatgatgcattattgaataaatcaggggcaacaggtgtatttactgatttcccagatacttgcgtggaattcttaaaaggaataaaataatttctattataaccgtaggtaagtttacttacggttattaatgccgtctatgatgaaattatcttttcaattgaaaagtgtttttcagaaagacttactatatccttaatgaataggaacataatatgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaaaaccaatttaaatataatttagtttggggctaagctcattttttactggcttagcctttttaatttttcaagttcactcaagtaatcatcattactacagcctgaagttttgctatgatgttgcaagcctttcaaaatagaaatctaattcaatgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataaaaatagggcaagtatttcgtttgccctaaatttttctcccataaatattgcgcactgagtaaattagcactatccgcaacgcgatgagcttgagcttggtcaatattgaattgctcacttaaccctcaagcggtgcacgctcgaatatctgcaacttggaagttttttctaggctataaatgacgccttcgcgcaatgcaccgtcagaatagcgcatttgttgaatatgaaaaacctcaaacactgcacttaaaatcgctaaaccgggtacaaaaacatccacacggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaagcctaaatcttcgattttattgaccgcactttggcgcacgcgttgaaagttttctggggaaatgatgccatcggtaaaaaaattgagtcgcaaaactcacgcatcccatatgtcggctttcagccataagcggcgtgaaatcatcgccgataatcatttctgtcgagccgccaccaatatctataacaagctttctgcctttttctggctgagtatggcatacgccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcggcaaataaggctaagcaattcacgccacgtgtgatagcctcttgattaagcaccgcattttcatctaagccttccgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagcgtcattcataacattcctaaaattcaaatttataaagtaaatcaaacacttggtttgtgctagaaacggattgaaaataaagctgtggcattaggcgataacgtaatgtaacttctgctaacccatcaaataaacctacgccatattttatttgtaagcgattggtaatattgccacttactgtaaccttagatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccactactttctaacgaacgacctgttaataaataagaaagtgcttgatcttgtggtttgcttggttcactgaaaatagtgacttctgggctatcggctatgccaatcactctcactccagcagtaattttgctgtcttccattgtttcaggattacgaatagcctcaatattcaacgtaggttgtgccgcttgcccagaaaaactaataagccctttacgaatgagtaaatcttgtccgaaagaagcatagcgacctttggttaaattgatttgcccgaataaacctaaattgcctttgtcttgtttcacagaaagtaaaccatcaagattggtttttaagccataggcatcaaggctgacgtctttaccaatattgatgcgtaaatcagagcgaatatccattcctgatttcgtttttgcggcaaattcacgtttaatcagttcttctttgctcttgtgcgggccgtttaaaatcacttcatcttcgctgactggctcagcagtatctggcagactgtcaattttaatacgcgcccaaggaatatccactgttccgcttaaattcaattccttaggattggcttttatcgtgatatctggactgaaacgtagcttcgccatagatggaatatccacgttgaaattatttgcttgtgcattcaattctgtcgtccaatgttcaatattcgcccagtttgcacgtccagttaagtttaagtgactatctactgtttcgattttcccttgcaatgttgaacggttaccattaaagcgtagggcaatatcgccatctgtaatattgactggcatagatttcaatttggtacgaatattacgaatattgaagtcaccatttaataatggtttctctaaattcccgccgaaactcaacttcgagactaccttaccattcactgattcaccgctagtaagtagctgatttgcgatcgacaagtttaatcgttctatcgcaagggttccgccaagttggcgagttttaacaaaatcatttaaacgaatatcgcctacaattctgccttgattatgcaaattgatgtctgtttttaaaaccaaattattattttgaatgtcggcattaagggttaattttggaatatctaatttaaacgtgcggtaatccaatttttgagagaaagctaaatgattgccatctacttttgtgctaaattggaatggtttatccgtaaaccaagccacattaccttgcgcttgcaagtttcctttgaggctatcttgttcgataagtttattcattaaatccaaattaacacgtttgaattggaaagggatattaccttgcttgcctgcattgaatgcttgtgggaaacataattctatatctgtgttttgccagcaatgtgcggcaatattggcttgtgtttgtttgttatcgtaagacaccgcaatagcttggttagattttacatcgccaattggggtttcaaattttgcttgggaaagtgtgcctttccactgttccaaagtgcggtcaaaatggccgttaatttgtaaatttgcagcaacaggctcgccttgagattttaggattaatttgtgattttgttcatcgcctgataaatcaagatcaagtaaatggagtttaatattttcgccataatgaagttgttctgatttaatattcaattttccactcgagagtggggtattgtttatatgaccttttatacttgctttagctaactgaaaaccttgtaaatgtaaattggatgaagttaaatcaagatcaagattaggtgtcgtaatttgaccagaaatcgctactcgcccttttaaatctgaccataaaccacgtaaatttggtgcatctatatctagcacaaaatcagaatgatcatctaatacgccactggctttaagataattttcgccatatctaatctgtaaatcaggcacggttagaagtacattttgattaagcgttgcagaacctttcaagctaattggttttgcagacaatattccatttaaatcagctgtaggcacttccacttgccaaccttgagagtccgcaaaaccgcgagaatgtaatttacccgataatatggcaggcataactggaacaaaaaaaccaatattcattttttctaaatcggcttgaatatcccagtttgcaccatttttccaatttgcattacccacaaattcacttttaccgtctaatgaagctatccccaatttatttacggttatttcataaagtttgccgtcggcattaaagtctacttgagatgcgggaatataattcattcctgccacattgcccttaaattcggcgtgataattcagtaaatcccccgtgagtttaagcgtcacatcattaattttgagtggcgtcattgtgtttacaaaagtgtattgtccttttgccacgtttaatgtgaggtttaagggcattttatcttgtgctaattgcacgttgccattcagttcagcatctaatacgccttttgttttcacagaaagtgcggtggattttttcaatgatcccgaaagcgtaagatccacatcactctctggcagaatttcttttccagcggatttcaacggctccaaatgggattttaaagttaaatctagcggcatatcgccatcgagttgtaatttaccttgtgaagaaagattacccaacgagctttctaccgctaatttttgtaattgcagttggttatcgacggtatccgcctgtgcaattaaactagacatttcaacagattgaagcgtttcgtctttttcattcactgcttgatactgccagtttttgcctgaaatttcaggaatatgtaaatcaaaaggaagaattatgtctgatacattgcctaaaaaagcaggcgttaaagattgctcaatcgcagcccaatctacaggtttattcggctgtttggctttcagctcaggtttaccttcgggcaatttttttgcaatcactgaaatatcgttaatttcagtcggcgcaatagttaagcctttttcattatttaaacttaccgcacttttaaaatttccaagcgtaatattagtctgatcaatgtttacagataaatcttgcaccaccaaattttctgcattgatactaattggcaaggaaatacgcttcattgagccagactttgaattatcaggtgccgatggaggcaataatgcagtattaatcgcaatggtcggtttatttaaggtgaagtctcgtaaacaaacttcacgtgaaagcaaacaaccaaaatcgagctgtaaacgtgcttgtgcaatatgtgtctcaatcccagcggtttgataacgaacattctttaacaccaagccattttgtaatccgccttcaatttgctcaacggaaaaactatcaagcattttatcgacaagttgaattaaacctctttgccccgcatcgaaagaaagcactccagcaacacctaaaacaggtataaaaatgaccgcacttccgatacaaacagccttgcgtacccaatgttttttattaggtttctcaggtaattttggtgaagtttctgatggttgtagttgttctgtcataaattcaccttaaatttctgtaccaagtccaatgtaaaattgaatatttttgctgttatctttatcacgaatgggtgtggcaatatcaaatttaatcgcaccaactggcgatgcccaacgcacaccaacgcctgcaccataacgcaattcttttgccgtgtaattatcggcagctaatccactatctgcaaaagttgccgcccaccaatttggatagacttgatattgatattctaaagaagcggtaagcaatcgcgaaccaccaactaattttccgtttttatttttaggcgcaatttttttatagccgtaaccgcgcacactacgatcgccaccagcaaagaaacgcagtgtaggcggaattttttcaataccttttgtatgtaaatacccgatttcagcacgagcaacgatacgatgattttctgcataagtacgaacccacgcgctagatgcttgcacttttataaaagaagattctgatagccaaattcgtttgcttaaatcaaaagtaattttttgcacatcgccccaagtggcaaaggaaccaccacgtaatcgagtacgagtaaatccaacagttggataaagaagtaaggttttatcagtgatatccgcttgtgtaaaactgtcgtatcgcgtacgaagtccgccaaaatattgccaaccatgcgcattattccaataacgtaacgctgacaacgtaagcactctcgtattggtatcgttctctttttccccttcccaaccgacggcaaaatcatagtaataatttaatggatttttaagcagtggcattcgataagttgcctctagagtttgttttggtgcagagagataaagatttgaacgcaaactatgtccacggctattaatccaaggttttgtccagcctatttgtccgtgaacgccgccatcagtagcaaagcccacaccgagttccatcgcattttttttacgtggataaagaatgatttctatatctaccgttttacttttatgattgatattaggctgaactaatactgagctaaaccaatttgaagatgaaaaatcgctggttaaatccgacaaattattcattaaatacggatcaccagatttgatgttaagaatattatttaagtaatcatcccgaatttgtgaatggctaaaagtaatattgccataatgataacggacaccactatcaaataacattcgccaccatgcttgatgggtttcagggctgatttctaaacgtgaaattttaaagttcccatcaaaatacccacgatttaatgccaagcgtgaaatcgctgttttgtaatcatcgtaagtttggtgctcaaccaaaacgccatctttcggtaagtttttacgcaatgcattaaaattttcatcttgtgcggcttccccctcaatttgcacatcagtccccgcaatttttgttggctcgcctggtgtaacatgagcaatcaataaatcgcgtttgccttgacgctgttttcgttcaaaacgcacggaagattcataataaccaaacacacgcaaaccacgatccacggctttggttaccaaatgttgatagcgttcggagccatccatttcttctttattaatcaaattaacattgagatctgtattacgcacagcacggaaaccacgaatgccttgaacttcaatatcaacagtttgttcagcaaatgcgggaaagcaacttaatgctaaaaaaagtgcggtgagttttagcgattttttcttcattttaaggggttaaaattttctaagtaaattgcactatagtctaccgagaagttcgttaggatccaatattttcagtgcattttgtcggttttttcataaaaaataccgcacttcattgccaaagtgcggtaaatttttgagctgttttaattagtgaccgccgcaaccacagctgccgtgattatgttcgtgattatgttcgtgatgatgaccaccacagccacaaccgtgaccttcttcgtcatcatcgtggctgtgtgcaccgtgaacgtggccgtgagcaatttcttctaacgttgcttcacgcgctgcaacaacttcaaccgtgaaatgtaattcttgccccgctaacatatggtttccatcaactacaacttcatcgccatcgatttcagtaatcaccactggaactgggccaatgtcagtatccgctaagaaacgcataccgacttcaagttcatcaacaccttggaatacatcttttggtacacgttgaaccatattttcgctgtacgcaccataaccttcttcaggttgtacacgtacttcaaatttgtcgccaacttctttaccttcaagtgctttttcaagaccgactactaaattattgtgaccttgtaaatattctagtggttgatttgctggagcttcatctaccaatacgccatcttgtgtgcgaacttggtaagaaatgctcaccactacatttttttctactttcattatgttttccttataaaaatcggttaaaaagccgtatcattgtaacgaaaattattccacgcgcaagactttacggattaatgaacacgaggctcttcttcatcttcatcatcaaaaaattccccatcgtcaccgtattcatcgtcatcggcatttgggtcttcaaaataggtgccccaaccatcataaatgcctttatgtttttctaacaatggaaggatttgtttttgttgtgcatcgataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcgatgtgatgctcaataatgtaaagcgcatttggatcactgccatcattaagtaaatcttcgataatttcacgggtttctgcttgtaattcagccaattttgacataataaaatccttcaacaagaacaaaagtgcggttattttagtggataaatcaccaaaagtcgcatagaatttcgcacaattattttcgataaaaaagaacccttaaccatgctcgaacaactcccttatttggcattaaaaactccgccaaaaaccaccgcacttttaaaggctgaatgcgcggattttattgtaaaagagcatttaggctatgaaatgtcgggcgatggagagtttgttgcattgtatgtacgaaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagtgcggttagattttgtggcaaattttggtttcccaaattattttacggaacaacgttttggtcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattaattgggtttgtggcggggttttagcccaattccttacaaggggtttacgctctgcgctggagtaatgcaaatggcatttttcccttttgttatcaccgcatttgtttcacgtttagcacgtttcttgctagtagcaaaattagctgcatggggcggtgaaaaattcgcagcaaaattgcgaaaatctattgagattattggctggtcagtggttgtactggctataatcgcttactttatactgaaaaactaggatagaaaatgaacaaattaagtcttgttttagtagctggatttcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataaaaatgaaataataacggaacaataaggaataactatgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaagatctctttaaaaagtgcggtaaaaaatctcaacaaatttttaccgcacttttttattaaaaatattctgtgaggagtatcacaaaataaaaaaataatagatgacaatgttaaattttatattattctgataatgcttcgtagttagaagtcagtgttaagttttattaagtatctcttctcttaaaaggagtttaatatgctcaacttgctctctcctaaccaaacttgggttcttgttgatccaagattatctttttattttcccataatttattaatcctttcttattaaccatcaaagtgttttcattttagaaaataattttttatttaaactaagcaaattaatttttggggattttgctatggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggtggtttagaaggtggtgcaatggaacgtttggctgttggcttgcatgatggtatgcgccaagaatggctggcttatcgtattgcgcaaattgaatatttggttgcaggcttagaaaaaattggtgtgccttgccaacaaccaggtggccacgcggcgttcgtagatgcgggtaaattattaccacatattccagccgaccaattcccagcacaagcactttcttgcgaactttataaagttgcaggtataagagcggtagaaattggctcatttttattaggacgagatccgaagacgggtaaacaactaccatgtccagcggagcttttacgcttaactataccacgtgcaacttatacgcaaacgcatatggatttcattattgaggcattccaaaaagtgaaagaaaatgcagagaatattaagggtttaacctttacttatgaaccaaaagttctccgccactttacggcacgtttaaaagaagttgaataatatcacgaaaaatgcagttcattttgaactgcatttttttatcaacagctaactcaataatttgttattgataaggatgttctatgaaaaaacaaccttccatctttggtggtgcgtgtattattgctagtgtttgtgttggggcaggaatgcttggtttgccgacatctggcgcgggtgcttggacaatatggtcagtattagtaatttgcttaacaatgatagtcatgacattgtcaggctggttattacttgaggcctactctacttatgatttaagagcttcatttagtactgtaactaaagatatgctcggttcaactgtcaattctattaataatcttgcggtatattttgtcgggggtattttactttatgcttataccactgcatctggcggtatactagaaaaccttattaaaccgtggattgattttggttcatctacattggcaatttgttccactgtatttgtattagttttttccttctttgtttggcactccactcgcattgtagacagaatatctgttttattgattgtatgcatgggttttacttttatttttagtacttatggattagcaactaatattagtttagacactttattagatattggtggaaaggagacaaattatgcaaaatatgcggtaggaatgtttcccgttgcattaacatcttttggctatcatcattctgtttgtacgatgcgagcttactatggggaagaaaaaaaagcaaaatacgctatcttaggtggaacagcaattgctcttacgctttatttactttggattttctctatttttggcaacttaccgcgagatcaatttgctccagtaattgccagtgatggtaatttagatattttacttaacacattaggtggagtaatcgaatctaacacggttaaacaaatgattaatgccttttctatcgccgcaattttatcatcttttattggcgtaggattaggcgtatttgattatttggctgatttctttaaatttgataattgtaaaattggacgaacaaagtcatgggctgtgactttcctacctccactaattatgtcaattttatttccattgggtttcttaaaagctattgggtatgctggtgcggtagctacgatttggacaagtataattcctgctcttcttgcctataaatcccgcaaaataaatacagctgcaacattccgagtgtgtggtggaaatggtttaataatctttattgcattatttggtgtttttgtagctattttccattttcttgcaatgtttggctgcttacctttctttaagttctaaggggaaaatatcaattttaagtgcggtaaaaaatctcaacaaatttttaccgcacttttttatctggctttttcccctttcggcacctaaaatagccgccataaaacctatctttattcagtttcaaagcaggtaattagatgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcgggatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtggggtaaatattatatcctagcgataaattcaaaggtttatatggattggcggaggggaatgggagttgaacccacccaagaacgctggcgtcctcaacaggatttgaaatcctgccacctcaccggagatgacgcccctccgtggttgaaattgcggtcactttagcgtaaattaatcggcaattcaacgttattttaaacggattcaaaaatgaccgcactttttcaacaacttccttccgttgataaaattctcaaaacatctcaaggtctacaacttattaccgaatttggtcacactgcagtcgtggcaacatgtcgagaattattaacccaagctcgtcaatttataaaaaaaaacaatcaacttcctgaatatttttctaattttgaccgcacttttgtagaaattcattctcgcctacaaaaacaaaaccaagtacaaatcaaagcggtgcataatctgacaggtacggtattgcacacaaatcttgggcgggcactttggtctgaagcagcacaacaagcagcgctttctgtgatgcaaaaaaatgtttcgcttgaatatgatttagataaaggtaagcgtagtcatcgcgataattacatcagtgaattattatgcaaactcacaggtgctgaagctgcctgcatagtgaataacaacgctgctgcggtattgttaatgttagcgacctttgctcaaggtaaagaagtaattatttctcgtggcgaattaattgaaatcggcggtgcatttcgtattccagatattatggaacaagctggatgctatttagtggaagtgggcaccactaatcgtacccatctgaaagattatcgtaatgctatcactgaaaatacggcttttttaatgaaagtgcatagcagcaattatcaaatttgtggttttacctcttcagtttcagaagaagagcttgcggaactaggccgagaaatgaatgtaccagtagtcactgatttaggtagcggcgcattgatagatttaagccaatatggcttaccaaaagaatcaactgtgcaagaaaaagtcgcacaaggtgtgggtttggtctctttctctggcgataaattgcttggtggcgtgcaagcaggcattattgtgggtaaaaaagaatggatcgaacaattacaagcccatcctctcaagcgtgcattacgttgcgataaagtcattttagctggcttagaagccacattacgtttgtatttaaatcctgaaaaattaactgaaaaattaccaactttgtacttactcacgcaaccattaaaacaactcaaaataaatgctatgcgtctcaaagagcggttagaatctcgcttaaattcacaatttgatattcaaattgaagctagccaagcacaaatcggtagtggctcacaaccaatggaaagaatcccttccgtggctgttactattgcagaaaaaacaaacgtaaaactttccgcactttcagctcgttttaaacaactttcccaacctattattgggcgaatggaaaacggaaaaatttggctagatttacgtagccttgcagctattgaaacattattaaatacattggatgaactatgattattgttacttcaggtcacgttgatcacggcaaaacagcattattaaaagcattaactggcacaagtaccgcacatttaccagaagaaaaaaaacgcggaatgaccattgatttggggtatgcctatctgccgttagaaaacaaagtacttggctttattgatgtgccggggcatgaaaaattcttgtcaaatatgctggcaggtttaggtggtgtgcattatgcaatgttaattgtcgctgcggatgaaggggttgcgacgcaaacaaaagaacatttagcgatattacgccaacttcaattccacgaaattattgttattatcacaaaagcagatcgtgcaaattcagcgcaaatagaatcgttaatccaagaaattaaacaaaattatagttttttacgtggtgctaattacttcgttacctcagcagaaacgggacaaggaattaatgaattacgtcattacttagctaatctacctgaattatctgatacccaaaaacctttccgttacgcaatagaccgagtattcaacgtaaaaggggcgggtaccgtcgtgacaggcacagccttttcaggaacagtgaaagtaaacgatgaaatttacctttccactggacagaaagttcgtataaaagcgattcacgcacaaaatacatcaagcgaacaaggtattgcggggcaacgtttagcgttaaatttaaatgctgatttagaccgcacatcaatgaaacgaggtgattggttattgcagaatgagccacttccaccaacagatcgcatcagtgtacaaattttggctgaagtaccattaaatgaaaaccaaccagtgcatatttatcacggtgcaagtcgcactacgggtaaactcactttattacagggaaaaaatgccgcaaaaaatgaccgcactttagctgaaatcatattggattcaccattattcttggcttttggagacaaacttattttacgcagtggcgatacaaaaaccttaattgccggcgcacgagtattggaaattaactcgccaaaacgtcataaacgcactgaagtgcggttaaatttcttagcgaatttagcattggcagagaacgcttcgcaacgtattgcgcttacccttaaacataatgcgacaacagcacgccaattaatgtggacggaacaactgacttccttgcaattagataaagcactcgtcgagcgagacgccgtacgttatcaagattggtgttttaatactaattacatacaagaaaaaacgcagcaaattttaaccgcacttaatacttatcacgagcaacataatgatcaacttggtgtaagcaaagccagattatatcgaatgaccgccttaaaccagcctgaaaacttgatcaatcattttattgatgaaatgttaaaagagggaagattacagcaaactcgaggttggcttcacttacccgaacataaaatccaatttagccaagaagaacaaaaatattggtcaagtgtattcgatgaatttgaaaaagcccaaggtcaagccatttgggtacgtgatatggcaaatgctctcgctattgatgaatcaattatgcgtaattttatgtataaagctgggaaattgggttacctcacgccaatcgtgaaagatagatttttcttaactgaaaccatctatgcttatgcgagactcatcaaacaaatcgcagaagaacaaggaaaagtttccgtaaatgaagtacgtgataaattgaatttcggacgcaaacttaccgttcaactgatggaatattttgaccgaatgggatttttacgtcgcaaaggcaatgaccatattctacgcgataagaatgtttttgatttatgatttaaaaaggaaaaaagtatgaaaaaaacgctcgttgctgcattaattagttctgtcatcttgctcacaggctgccaagataaagatactgaagcaaaaataaaacaactaaatcaaacggtagcacaactcagtgctgaaaataccaaattaaaagagcaaatagaaaaaacagttccagcaattattgtggaaaatgatgaaatatttaatcaatctgaaattattaaacatcctaaatcgaaagaagattaccagcctgaagaaaccaaaattgagtattcaatttcaacaataaaaaccaatattgattggcttaatgatctattgtggaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaaatcctttaacttttgaatagcaatcaaaatccctaattacattaaaaatgagagactatagattttgcacttcatctttattataatagtctttcaatgtaatactaaggagaaaaattatggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataatgtcagaagagaagccattaaaagtaagctattcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatagaagtaatcttaaataataatccgcacgtaaaatgtgcggattatttttacataggattaaaattcaaactgaacagacattctgtaatttctgccaggtgcataaaagcggtttaagccttcaccagtttctgtttttactcggttaattgtgccaagatgtcgaacagagcgagcagagtcccaagtgagatattttttgttggttaaattatatacaccagcggtaaatgtaagatttttaattggtttccaataggcaatcgtatcgatcactgtatagcgattattacgccataatccgcgagaatcttttacatctttgccgtttgcttttgtagcaggtatatctgttgcattgtcagtatattgcttttcttttctggcgaccatacttgtccattgagaattaaagctatcttttgctttttttgctgcaacattagtgatatacatatccacgccccatttttggcttggtgcatcatagccaatattgtataccgatgtggttggttgtaaggcattcattggttgaggtttacgagcaatggcttcgtattctggatgttcatctttattcaattccaaaaattctttatattttggatgtaatccattgtctttgattctgcctttttgataggtaaatttatagcctaaatggaaaccttgtagtttttcaaataaatcgcccatctcaagacgtgaagcaatttcgatacctctgactcttgctcgatctcgattttggttttgatggaacggatattttattgcagagccttcttcaataggacgttcgcccacttctactaagtcaataaaattacggtaatcgttttgaaacgcatttaacgtaatataactactgtttttataaaaagtgaacgcgacttcttttgttttggaggtttcagcttttaaatctgtgttaggctgaatggaaaattgtggatgtttaaatgtcatataaatttcatcagaggttggcgcacgaaaaccattggcgtatttaagctgtacacgaagccaatttgtgggatcaagatttaaccctaaattgtaagaatgatgtttatagtcagttttgcgtaataacagggcaagattgtcttcaaaattttttttataacacggtgtgtcgtaagtgcaattttcatatcctggaggtattgagtatttactaccataaacatattcctttgagctaaatttcttaaatagcccagtaattaatccattaggaacaggaatgtttttgtcataactaggcaaatattttacgtggtcataacgataatttaaatctagtcctagccaagaggtaagttgcacattatctccaaaatacaacacattatttttagtggtaacagggattaaataggtatctttacctttattggaattcattaagctacatctgtaagcactatgatcaggtgcaggagtatgctccacaggatatgtgccatctacaggtttgttacagaaaaaattgccagcccaccattgcacattggcaacagtgtagtattgatgattcaccatactttttagtgttttttcataaagtccaccatattttagttggtgttgggtatgccataggtgaaattctttgtctaaatcaagtttaatttgttgggtatgggtgtttaaatcacggtcattaacgaagtctgtgctgtagccatggctttttggaaataaaaatttagcactttcatattgggttaatccataattaccttctgctgattttagtgagatttcaccatattttttgccatttaattctttaatggtaatatttcggtcttcataattatatttgtcattcccattttcatcttttccaacaaaaacctgaaattttttattacaatttaatttttcacaattaattaagaccgaatcaagtgagcctccttctgtatctacatcattactaacatcttcaccctttttgttttgtagttctaagccataattatattttcctgtaaattcttgattgtctttatctttaatcttataaattccaccttcttctactaaatgtagcccttgtggattacgtacaccagcacaagtggattgatgacaatactcatcagagcgtgctttattggtaattttttgtgaggaataacttagtttaatatgatcccaaaaaggggtttgactgaaattttcataactaaattgaatattttttcttttagattgatcattaataactcgctcgccatatttttcctcacatttagtatttttgcattgattgaaaatataagacaaatccataccctttgtttctaaagtggaatcatctaatgccacgctcaagcgatggttttcattaggctgaaagcccaattttattaatgtgctttggcgggtaatttgataaggatcggctttttcacgggtaggaccaaccgcacttaaatccgcctgtttattgggataaattttataatcgtagttttctatttcgtgcccatcacgttttgtatcaacgactaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcaccactaccggattttaaggagtcagcacctttggtaatagttgctgttttaacattttcaatttcaatgctattacgagtattattaaaattgccatagccttcaaataattctttaaatccttgagagcttaaggtttcagcttgacgaagcccatcaaccataatacctacacggttttcatcaacccctcgaacagcataaccacttgcgcccgttctacctgtttcaaccaccgtaatacctgtttcatagcgaacgagatcacgagaatcagacgcctgctgtttcgctaattttttggcagaaatttgggtttcacctacctttttctctttcacattaattgtttctgtacttcctgaaacattaatttgttctagttgttcagaaacattactattttggttggttggttggttggttggttggttggttggttggttggttggttggttggttggttggttggttggttggttgggcagcataagctgtgcttgcatttaatgcaaatgcaatagagcaagcaagcaggctgaatttaaagttggtcataggtttccttatttttaatgataataattgtcatatattaaataattcaatttatctaatcaatatcaaaaaaagtataataagtacaaaatctaattgctttatatgagcataaaagaaaatcatttttgaccgcacttttgtttgtaagtcatattttaaaattatcaaaatgcaatttttaatcactcttttatcgactgcgtagatttctttcgttataattgagcgtctttttatttaacaaacgtgttcggtgtggattttgaccgagtgcaaattaattgaggtaacaaatgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttgatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggtcctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtgccagcttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataataagtaatattattatgattgaataaaagtgcggtcgctctttttaataaaagcgatcgcatttttatttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaagggtatataatgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcagatgcaaccacattaacggaagctggttatgtgggagaagatgtagagaatgtattacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatagcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttgatgaaatttggtttaattccagaatttatcggacgcttgccaatgattgccccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcgccaaaattagaatattagatttaatcgcaaaagtgcggttgttttcgccagattttctatgttgatgcttattttcaataggcaaggcgaaaagaaaatgctacaatcgcacgttcttatggcattattttttacatttccatttaaaacggattcaattctatggcaaccgaaattgttgataaaaagaaaaatacgcaagaagtgatcgttgaaggcaaatctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaaaatgactgaagaaacaacagtatcaaaaaaacgttggtatgtattacaagcgttttctggctttgaaagtcgtgtagctctaactttacgtgaatacataaaacaacaacaaatggaagatcaatttggtgaagttttagtgccaactgaagaagtggtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggtcgcttaaaagtgtctgtatcaatctttggccgtgctacaccagttgagcttgaatttggtcaagttgaaaaaatacactaagaaatgattaaaatataaccgcacttttgtagtgcggttttttgtttttaatgtttgttgaaacagcataaaagagtgtttttatacgcaaaatttgttgttatttcacaaattaggtagaataatcccatatttatgtaaggatcaaaaatgaaaacaaaggtaattttgaccgcacttttgagtgccattgcactaacaggttgtgcaaatcacaacgccacgaaacaagcaagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggtagctacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaataaacagaaaagtgcggtaaaaattacccaattttttatcaactaaggagaaaatgatgactcaaattattcatactgaaaaagcaccagcagccattggcccttatgttcaagcggttgatcttggcaatctagttttaacctcagggcaaattccagtgaatcctgcaacaggcgaagtgccagctgacatcgttgcacaagcacgccaatctttagaaaacgtgaaagcgattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgctgtaagaaaataattttctgtttggtaatccctgcttaaaagtgcggtcataaactcgcatgtttttgaccgcactttttgtttatctgctgataacaaaaattttacattacaccttgaattttttgtgaattttccccacaaaggaaatacttaaccctaactttgagagaacacattatgatgcgaattcttcttttcttggcaaccaatatggctgtaatgctggtattggggattattttaaatgtgactggtattgcaggaaatagcactggcggcattttaattatggctttgctatttggttttgctggttcattaatttccttattcctgtctaaaacgatggcattacgttctgtagatggagaagtgattactcaacctcgtaatcaaactgaacgttggttaattgatactgttagtcgccaagcacagaaagcgggaattccgatgccagacgtggcgatttatcattcacccgatgtgaatgcttttgctacaggtgcaacgaaaagcaattctttagtggcagtgagtacgggattattaaacaacatgacggaggctgaagctgaagctgttttagcgcacgaaatttctcatatttccaatggcgatatggtgacgatggcgttattgcaaggcgtattgaatactttcgtgattttcttatctcgcgttatcgcaacggcggtagcaagttcgcgtaacaataatggagaggaaacgcgcagttcaggtatttatttcttggtttctatggtattggaaatgctctttggtgtgcttgcgagtattatcgcaatgtggttctctcgttaccgagaatttcgtgcagatgctggttccgcaagtttagtaggcaaagaaaaaatgattatggcactgcaacgtttgcaacaacttcacgaaccacaaaatctcgaaggttctttaaatgcctttatgattaatggtaaacgcagtgaactctttatgagccatccaccactcgaaaagcgtattgaagccttacgtaatctttaaaaattataaaaaatcgaccgcactttaatgaggtcgatgttttattttcctcttttcacccaatatttgaacgggggcttttccacttcactttgcagtaatgtgtgatccataaattgacagaaacttggaatatctcttgttgttgcaggatcgtcagcaataatcaaaagtatttctccatcgttaagatgacgaatatttttacgaacaagcatgacaggttctgggcaacgtaatcctaaagtatttagggtttgtgtgacggaaatttcagacatattcttttttcttttgaaaaacagagccatatcataccgcacttacggcaaaatttcgacaaatcccagtcatcagtgatagactagtgtcattgaaattaccttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggtagtcaattaggtgaaatcagtgcggtggtggttcgctattatggcggcattttgcttggaacgggcggattagttcgtgcttacggcaatggcgtacaacaagcgttaaagctgattgaaagcgaaattaaagttgaacgaacccctttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattggttattcaacttttagagataggcgaatagttgtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgacagcgggcacattgctttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggcctcttaaagatcaaaaatctttgcctaaaatttcagaagtggcgaaagcgctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcggtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattatttttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataataataattggaaaattattgtatttttgaccgcactttttaataaaatgtttatatttccatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaagattaaaaacgaagcgaaagcaacgttgaaaaataaacgttaaaagataaaaagaaaatagagtatctttaattgatgtccccatcgtctagaggcctaggacatcgccctttcacggcggtaaccggggttcgaatccccgtggggacgccaattaaagataactttattagattgtcttactgttctttaaaaaattggaaacaagctgaaaacaagagattttcgagagaaagtctgagtaggcaagacaggaaagtgaaagagagaactgaaaaggaaactctaaaaacaaacctgttttgtaaaaaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgataccataccgaactcagaagtgaaatgttgtaacgctgatggtagtgtggggtttccccatgtgagagtaaggcactgccaatcatcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccattaaaaaacctttcattttcaataatttactacattgtaaaaattttcttgtgagaaataatcctattcttgtagtgtaaatgtgacatttattcataaactttattatgtgatcgcatttaaatacgtaggaatataataatttctaataattatttttaaataattttgaccagttttataattttacattagtatacgagtcttaattttgttgtaaggaataaaaatggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatagttttagattcaaaacaacaaaaaacgcacttcacttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagatcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgtgctgcaggtaacttgttttgttgcaataaaatgcgagtacgggcaatttccacgagcaaattatcagagccggctaattctgtcgcttcaattaaatagcgatttgcactaaattcgtcgccacgttgttgagcagcttctgctgctttgatgagatttagtacaggttcagcagaatgtttagcatttttgccaattaatttttctgctttagcgtaatccccttcattcatttttaccaagccttcaagggtttgtttttgcgcttttacacgtttgcgattagaaaaccattgataagagctacgacttaaacgaaagaaacgagtgatgccccattcaaaagcataaattattgctaaagaaataatgaaaaaaatcactaaggtagtgatggacatttctataatacgatttgctgtctcaatgcgcacataaccttgctgaccagaaatataaggccctgctacaagtcctacaagcaatgtcagcattaaaaagagcactctaaacatagacttatccttattgttgtgattcagattgtgttggtttaacagcttctactttaggcattgtatcaatcgccttgtctgcttcaatttccactttttgtagatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcacttttttcaatattttgttgccagtcagtaatgttgttggataatttatcattatttttagatgtttcatcaaaatttacattcaaagcctgtaattcatcgactgtgtttgcaagctgtgacagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaatttcagctatttgttgctgaccaaaatagtatccagctccaccaatacctagcgcaacaagtattgctaataaactcaatgctgtacccgtttttttcacaatagtttgcggaacagactgcattgtttcagcttgttcaacagctgttttgggcgtatctgtaagttgttcagtgaggtcgttaggttgctcttttgccatatcaattccttaataagtgatattgagtaaggtattttataatactttgcgttgataagaaaaatatcaagctatccactaataatagaaaatatagatttttatatcggcagaattaagctatttacgcaataaaattaggtgctatcctaccactcttaggtaaaaaagtcattttgattgttgataggtaaaacttataatatattttaaaaaaattgtgatttatgtcacatttttttgcatttatactccctaagtggtaaattgttcgccaatttttgttgttctggtagggacaccacgtggaatgtaatctagcacaagcaaaacaatgggttagcgccttggatcaacgccgttttgagcgtgcattacaaggttcaggcgatgcattccaacacgttttagcgattgcacctttacttctacacctaaaccatccgcaacttcccggctatgttattcacgccccctctggcattgcgaatttccttgcttctgattatcaaaaaaaatggctcaccaatgaatacagtattcactatgccgatcataagccatcaacactcaaaagtgcggtaaattttcacgaagttttaccaccaattctaggcgtttatgtaatgggtagctttggctcaataagtcaaacctcttcttcagatcttgatacttggatttgtgtccgtgatggcttgagtccagatgaatatacacttcttactcaaaaagccaagcggattagtgaatgggcaatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggctggtaaacctctactttggttgcatttatgggtggaaaatgaaaaagactatgaaaaacaggtggcgcgtttaattactgaaggggaaatagatccaaatgattgggtggatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttactttcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcatattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgtggcaataaacattttaaagatagttggtaccttatcaatcaaccaatacaccatattatgttctccaaagaacgggtgatcgaatacggagaaagcctgaataaattagtttcttgggcttatttcaatcatttactcacagaaaaaaccgaattgtcaatttttagcaagaatgtgactttaagcacattgcaacgctttgtcactaacttacgtcagtcttttccaagcaccatcgccaaacaacctaaaaatagcgatttattgaatcaatgtgaaattcgtagcttgtttattgccataaatctcacgaccgatccaacatccaaagtagaagaagtattaacgggtatttcatcgcgagatttatttagttttggatcgcttgagcaaagccttgtgggcagtattgattttacttatcgtaacgtgtggaacgaaatccgaacgctccattttgaagggcaaaatgccattttgcttgcactaaaagtgctttctaacaaaatttatcgtggcgttaatcgcccagattccatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcggcatcagcttacaagaaatcggaaatgaatcggtctgtaatgacgctgaaagtgcggtggattttgacgaagttttacaaacaccaattgaagatggcgagacaaaccaagaaagtcgtcgctatccaccagaaatggatgccttcgcaagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaatattttcctgtggttgataggttaccgaaagatatctatacttatttcctcttttactagataaattgtagatatgataacttcgcaaacaccaatcactgtgctaggtgcgggatcttatggaactgcgctggcaattaccttttctcgcaatggttctcccactcacttatgggggcacaatcccgtccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaattaaaccgcacttaaaagcccatcaccgattaatttgggcaacaaaaggtctggagcgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcgcgggaatttcagtctcgtattcattgtagtaaaggtttccgagtttatataaattcggatatgactggcgttcaacttggtggtgcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaaacgcacaagatgtagcaatcagccttttggggcgagcatgtaaaggcgaataaaataaaaggagaaattatgacattagatgtgtggcaacatattcgccaagaagccaaagaacttgctgaaaacgaacctatgcttgctagtttttttcactctacaattttaaagcatcaaaatctgggtggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccacgcaattcaaagctatcgaattacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggggtaacacttggcggtacgggaaaagaatcaggcgatcgtcatcccaaagtacgcgagggtgttatgattggggcgggtgcaaaaattctcggtaatattgaagtgggtaaatacgccaaaattggggcaaactctgttgtgcttaaccccgttcctgaatatgccacagcggctggcgtgccagctcgaattgtaagtcaagataaagcagcaaaacctgctttcgatatgaaccaatattttatcggcattgatgatggaatgaatttaaatatataaggagacaccatgatcaacaaagatacccaactctgcatgtctttatcaggtcgtccgagtaatttcggtactacctttcacaattatttgtacgacaagctagggttaaatttcatttataaagcattcaccacgcaagatattgagcacgccatcaaaggcgttcgcgcattaggcatccgtggttgtgctgtttcaatgccattcaaagaaacttgtatgccatttttagatgaaattcatccgtcagcacaagccattgaatccgtaaataccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggctgcctttaaaaattcaggttttgagaaattaaaaatttacgcacgcaacgtaaaaacaggtcaatatctcgccgcactttatggctacgcatacattaattctttagaaaaccaacaggcagatattttagtcaatgttacgccaatcggcatgaaagggggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggtgcagaagtgattgtacttcaggctgtagaacaatttgaactttatacgcatcaacgcccaagcgatgaattaatcgctgaagctgcggcgtttgctcgaacaaaattttgaaataaagatatggtacattgtgtttttattaaaatttgttgctctcgatcacatttctgaatattgctcgttgcatctttataacattcatttaacattgaaccctatttaagtgatagctctaacggaggaactttatgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattattttttcagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataatatagaattgtttacttttaataaatgatgattgaagatcataaatttaaacgtaagaagtacaataaagccatttaaataaatgggttaaagcaaatgaagctttaacccatttttcataaccgttctatacaaatctatttattgtgttcataagcataaagcgtattgctcatcaacattgcaacggtcattggcccaacgccaccagggactggtgtaatgtaagccgctttttcggctgctttatcaaactctacatcgcctactaattttccatctactcggttaattccaacatcaattacgaccgcactttctttgatccaatcgccagaaattaaatttggtttacctaccgcaacgacaagtatatctgcttggcgaacgtgattttccaaatttttagtgaatctatgtgttactgtgacggttgcccctgctaataataattctaaagacattgggcggccaacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaagaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttgtctgtttaactagatcctgtttagttttttcaaatataagcactttcagtctgttagattttatgctcataatctgcatcatttgagtgaagaagcttaaatacactcttaatgatgcagataaaaacaatattttggctatttaagtattttccaagctctgaagccataaatggcaattactacaaaacagattaatggtaggataaaggagaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaagacataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccctcagctttagtgaagcctaaacgttcagcatattgtacgataaatgtccaacacataatttgaacacccacgtaaaaggcttgtgcgatcacaccctcacgatatttagcttttttagccagtttgcttattgcacttttaaagctaatttgtccactttcttctacttttacagcaggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaattcgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaagacaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagactggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtactttcagaaatgtccacaacatcaatcggtaaatttaaggtgtttgcacggatttgattccacaatacattttttgaaccacccccaacacaaattaagcttttagcttggaactgactgacttgatgtagcacggataaaccgtttttgagtttatttgccatatgttgtaatgcgctgacataaatttctccacgagtagcaaacatggaaagtccactgatattaccttgtcctttttggctaaaaataccttcaaaattgaccgctctttttcccgcattaaaagctttttctccctctttgatcattgtggtgtaatagtgatcgctaccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacccagcgatgctaaaatcgatggatcccaattaccgctagtaaggtttgtcatcattgatgttcccgccattgtgtgatctgtagtgaattgaccagttaagcgttgagtgagcattgacgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcatttttatcaaaaggtgcgccatccacgccgaaagtggtaacagatattcctacaatatcttttaaatcaatgccttgttgtattaattgattgaaggtttgagttgcacaagagattaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagtgcagtcaaaaatccttatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgctccccaatttgccatgactgaatacacatcagtaaatgcaccttttccagttaaacgtggaacaaaccatgttgttggccaagtttcattagtacgttgatttaatttattatgtacatcttgaggtaggtcgattgaccatccttcagcaatttgtagaacgggacctagacctttaataaggttaatgcggtgcattgtaaacggtatgccacctttggttaggaattgagaagataaaccgcccccacgaaaatattcgtgaacagcaggacaccaacgcgtattttctaagcaacgttttgcttcttcttcggtgacatcccatgccggttttaaggttggattgccttgagcatcttgatgctctcctgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcatagcctccataaaatctccgtttggcaaatgatcagtccaatgacgctgcccttgaaaacctgctgcaatggcattatggcctaaggcttcttctgcataatttaatgttgctaattttggatttcctaccatcaaatcacgagtgataatggtcattttcacaacattttcccaaagttctgcacgctcttctgcattgcgttgattctctaggctatttacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaagcttgatttacaatagagcctgcaattcccatggaaactgacccaatagataaataggattttcctcgaatacttgcaacagcaagcccagcacgagcaaaacgcaataatttttcttttacatcttcaggaatgtttgtgtcatcagcttcttgaacttctgtaccgtaaatggaaaaggctggtagtcctaattgagaatgaccagcaagggcagcagctaagtaaaccgcgcctgggcgttctgtgccgttaaatccccaaattgctttaggcatgtgaggatccatatcaatggtttctgatccataacaccaacaaggggtaacggtaatggttaatccaacgttttcgcgtttaaatttatccgcacagacggctgcttcagctacaccaccgatagtgctatctgcaactacacattcaacgaaagtaccatctgtatgacgaatatgtgtttgtaataattgagcaacagattgagccatacgcattgtttgggtttcaagagattctcgaactcccattcgacgaccatcaatagttggacgaataccgatttttatgcgatttaattgagtagcaagagccatagttacactcctttgtttgtgcttaagtaagaatgatgaaatcactgcggaacaaattgtgctttcattgaattagagtgtgaaagaaaaatgatgaggaaaatagtaagaaatgaaattttgttgcaaaactgagaagcagatcacaaaaattgaccatatttaaggaaatatatatgaccgatattttaaatttttaataattttcggtcaaaatggtcatatttttttataaaacggtcattatatcgtgtagctcacaatatttttgtaagttatctggaagtggttgatcagaaaaaatcgtattaattttgcttaaatcggtaagttgaatcaaacttttcttttcaaacttagaagaatcaattaacaaataagcacgttctgaagcctctatcatttttcgtttcaaagaggcattcagctcatttgattcccagatattaccgttttgatcaattcctgaacaagaaaacacggaaaaattaatatgtaatcgttgtaataaatactcagataagggaccgtaaaatgcttcatattttgctgaataaactccgccagtgacaatagttttaacattggatttattaactagggcattaatgttaaacattgagttggttactactgtacaaggaatatcgggcattaaataagcaaaataccaacttgttgagcttgcatctaaacctataacggcattttcatatagcaaatccaaggctttttgggcaatatgtcgtttagctgttgcattaatatgttttcgagtttggaaaaatgaacctaaatctttggttttattactcactgctcctccgtgtgttcggtgcaataagcctttgttcgctaatttgttcaaatcgcgacgaatggtttccaccgaaatatcacaatgctgtgcaagttctattacgctggcttttccttgttgatttacccattgtaaaattaattcatcacgataattcatctcttttccctacacggtggatttagtcgagattctagtttacgcttgagtatgttgaaaatccaagaataaattatattgggggtgacgtatatcttcataaaagtgcggtcaattttttgtgagtttcttttcaagagtatgcgagctacaatacgccccaaaattttatcaatgtaaatcagaaagagaattattatgccctttgctattggtcagcgttggttgagtgaaagtgaaaacgctttaggattaggtgttattaccgcattagatcaacgaaccgtcacgatttatttccccgcagcagatgaaacgaggatatatgctgctgcacaagcacctttaagtcgaattgtgtttagcaaaggcgaaacattatcccatcaagctggctggcaaggcgagattttagacgttcaaaatatgaacggtttgttgttttatttagttaaaaccccacaagatgaagatgtcattgtgcaagaacgtgatatttcgccgattatttcttttagccaagcgaaagatcgtttgttttcagcgcaaattgatcgcagcagtcattttgcattgcgttatcgcacgctttgtcatcagcaagcacaatttaaatcgccattgcgtggtttacgcggaacgcgtgcgggtttaattcctcatcagcttcatattgcagctgaagtcggtaatcgagttaatcctcgcgtgttattggctgatgaggttggtttagggaaaaccattgaagcaggaatgattttgcagaatcaactttttgctgagaaagtgcaacgtgttcttattattgtgccagaaacgttgcaacatcaatggctggtggaaatgcttcgtcgttttaatttgcatttttcactttttgatgaagaacgttgcaatgattttgatcttgatgctgttaatccattcatgactgaaagcttaattatttgttctctaaattggttagaaacgcatccaaaccgagtagaacaggcacttgatgctcaatttgactgtttaattgtggatgaggcacatcatctggtatggtcggaaagcgcgccaagtgcagcttatttattagttgaacagcttgctcgcatcattccctctgtcttgttactcactgcaactccagagcaacttgggcaagaaagtcattttgctcgtttgcgtttactggatccagaacgtttctttgattatcaaacttttgtgaaagagcagaaacgctaccaacctgtggttaatgctattgaatctttgctggcaaataaggcattaagtgcggtagaaaaaaatcatatttctgatttgttgcttgaacaagatgttgagccactttttaaagcgattgcatcaaataatgatgaagaacagcatcgtgcccgtcaggaattgattcaagccttaattgatcgtcacggcacggggcgaatgttattccgcaatacacgtcaaggcgtgaaaggtttcccccaccgtgtttaccaccaaattacactctcggaagagaatgataaaattgattggctgattaatttcctcaaactacatcgcgatgaaaaaatttttgtgatttgccagacagcggcaacagcgattcagttagaacaaattttgcgtgaacgtgaggcgattcgtgccgcagtgttccacgaaaaaatgtcgattatcgaacgggatagagccgccgcttattttgcggatttagaaaacggcgcacaggttttactgagctcgagtattggctcggaagggcgaaatttccaattcgcagcaaatttagtgttatttgatttaccgacaaatcctgatttattggaacaatgtattgggagattagatcgtattggacaaaaacgtgatgtgcaaatttatgtgccttgtgcgaaagattcgcctcaaattcgtttagcgcgttggtacaatgaggggctgaatgcttttgaacaaacctgcccaatgggaatggcattattttcgcagtttgaggacgagttggaaaaagtgcggtcaaattctaccgcactttcagagaatgaattttctgaattattaaaacaaactaaaactgtgcgagaaaaactcaagattgagttagaaaaagggcgagatcgcttgttagaactaaattctaatggtggaaagcaagcacaagcgttagcggatcaaattgctgatgaagataattcgcctgagcttgtgaattttgccttaaaattatttgatattattggcgtagagcaagaagatcttggcgcaaatagtattgtaattagcccaacagggacaatgcttgtgccagatttccctggtttaaaagaagaaggtgtgacggttacctttgatcgagaacttgcccttgctcgcgaagaaatggaatttttgacttgggatcatcctatgattcgtcaaggtattgatcttgttgcttcgggagatattggcaaagccgcaatggcattgcttgtaaataaacaactgcccgctggaaccttattaattgaattgatttatatagtggaaagtcaatcgccaaaagggttacagctcaatcgtttcttgccgccaacgcctattcgtctgctgcttgataacaaaggaaataacattggtgagcaggttgcctttgaaacattgcatagcaaattaaaaccacttggtaaaaatattgctaatcaaatggtaaaaatggcgcggggtaatattgaagccttgattacacgaggcgatcaactcgtaaaatctttagctgaaccgattattaccgaagctaaaaatcaggcagatcaacaattaagcgcagaaattaatcgtttgcaggctttgcgagcggtaaatcaaaatattcgccaaagcgaaattgatattttggaacaacaacgaacacaatcactggatgagctttctaaagcaaattggcgtttagattgtttgcgtgtcattgtgacgaacaaggaataaaaatggcattgattgaatacaatccgccccttgaaccttatttagatattatttatcaagataatcatttgtgcgtagtgaataaacctagtggtttgctttctgtgccgggtaatcaaccacaatattacgatagtgcaatgagccgagtgaaagaaaaattcggcttttgcgagccagctcatcgtttggatatggcaacgagcggtattattgtgtttgctttaagtaaggctgctgatcgtgaattaaaacgtcaatttcgcgaacgtgaaccgaaaaaacattatcaagcgattgtttgggggcatttggagaaagattatggcgaggtaaatttgccaatgatttgtgattgggaaaatcgtcctcgccaacgtttggatttcgttttagggaaaagagcggtcacaaaattcgaagttttagcacgtttgcccaataacagtactcgcgtgaaactgacgcccgtgacaggcagatctcatcaattacgattacatatgttggctttagggcatccaattttaggcgataaattttattcacatcctcaggctaaagctatgtcgccaagattatgcttgcacgcagaagaattgacgattacccaccccattacaggggaaacaatgacttttaatgcgaagtcagatttttaaatttccgtagaaacacgagatcacgaatgaaaaactttttagctcaacaaggaaaaatcacgctaattctcaccgcactttgtgcgcttatttatattgctcaacagctgggttttgaagacgatattatgtatttgatgcactaccccgcttacgaagagcaagatagcgaagcgtggcgttatatttcacatacattggtacatttatctaatttgcatattttgtttaatctgtcttggttttttatttttggtggaatgattgagcgcacttttggttcagtcaaattattgatgttgtatgttgtagcatctgtaataacaggatatgtgcaaaattatgtgtctggccccgctttctttgggctttctggtgttgtatatgcggttctaggttatgtatttatacgtgataaattgaatcatcatttatttgatctgccagaaggttttttcacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaagtccgtttaatttggataaaggattcgctatgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaggaagttgcaaagttgattcctaacggtgcatcgttgtttattgatattggtacgacgccagaggctgttgccaatgcgttgcttggccacgaaaaactcagaattgtgacgaacaatctgaatgccgctcatcttttacgccaaaatgaaagttttgatattgttatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaaaaatatctttgattttcttattaatttgtcgataaaagaagctattactcttaatttttgatttaattgaaatttatctaaaagtaatctaaatattctctcgctgaattattgtcttttctataattaaacatttccaagcgtaaaagtatcttgcttttttaatcaattaaagaaatttcatatttctgtattatctaattatttttagctaccaatattctttaaaacattccgagcttagataagaaaatcccttgctgggcaagggatttagtaatgggttaaagtgcggtagaaattaccaaccttttacaacgccatctttaaagtgtttttgagcttcttggtaaacttcttctgtttggtaagattttacgaaatcttgaacagctttgctgtctttgttatcggtacgagaaacgataatgttcacatatggcgaatctttatcttctacaaatacaccgtcatcttgagcatttaagcctacttgacccgcataagtattgtttactacagctaaatcaacgtcgtctaatgcgcgtgccgcaacagaagtatctacttcagtgatgtttaattttttcggattttcaacaatatctaatacagttgaaagaaggttatttgcatcttttaatttgattaaaccttgtttttcaagaagaattaatgcacgaccacggtttgttggatcgttaggaacaacaactttagcaccgtcttgtaattcattcacatttttgatttttttagaataacccgctaatggatagacgaaagtattacccacgataactaagttatttaaatttttcgcttttgcatcttcatctaaataaggtttatgttgcattgcgtttgcatctaaatcacctttagatacagcttcatttggtaatgcgtagtcattgaattcaacgaattgaacgtctaaaccgtatttttctttagcgacttttgctgcaatttctgcaacttgatgctcaggaccagacattacaccaactttgattttaagcggtgctgctgcagcttcaggttttttgtcttctttacagcctgttaaaacgagagctgatgcgattgcagtgattgcaaaaagttgttttaatttcataggatttccttcctgtttaagttaagagttgcatttaattaacgatgatccacttttctagccagtgtatcgccgagtttttggctaatcataacgaatagcacaataataatggttgccacccaagtgacataaggcatattgcgatatacgccgtagttgatagcgaggctacctaaaccaccgccgccttgcgtccccgccattgctgagtaaccaactaaagtgactagcgtgagcgtgatgccattaattagcgtaggtagagcttctgacaaatagaatttacgaacaatttgccatttagtagcccccattgcttgagctgcttcggttaaaccatttggaatttccattagtgcattagcagttaagcgagccacgaatggcattgcacaaatactcaatggaataattgctgctgttgtacctaatacggttcccacgatgaaacgagttacaggtaataagattaggagcaaaataataaatggaatggaacgcccaatattaataatcgtgtttaacataaaatgagtgcggttgttttgtaaaatctcattttttccagttaagaaagtccatacacccacaggcacgccgactactacggcaagtaaagtagatgcaaagctgatataaacagtttcataagttgctgttgcgacacaccccacatttgaggtgttaattgctggctgaatgttgccaagaaatcattgaacataaccaagcacctccacgcgcacgttgttttccattaaataaactttggtttgcgtaatggcatcttcatcgccttctacttcagcaatggtataaccaaatttcacgcctccagcataatcaatttgtgaggttaagatactgagctccacgccaaatttttttgatgcttgagaaagtaacggtgcatcgactgagcgacccgtaaactcaaatttgatgattggatacgctttgctgtgtttcggtgtatcagtaagattttccaaatattcatcaggtagactgatgtggaaggtcgaacgaataaactcttgtgctaattctgttttagggtttgcaaaaatttcaccgacagtaccttgttcaactaggcgaccttgatcaatgacagcaacttgatcacaaatctgtttaacaacttccatttcatgggtaatcaacaaaattgtaatacctaaagtgcggttaatttcttttaataattgcagaatagattgcgtcgttgcaggatctaatgcgctcgttgcttcatcacataataagactttaggatcgctcgctaaggcacgtgcaatggctacgcgttgtttttgcccgccagaaagattgcttgggtaagcatcacgtttttcacttaaaccaacaagatctaaaagtgcggtaattttttcttggatttttgcttttgactcactttccaattctaagggtaatgccacgttttcaaatacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagcgcagtcaattttttgttcggtagctcaaaaattttcgtaatattatttagcttaatcatataagccctttttatttattgtttttaaatctgttttggtattctagatgtctagattgctatgtcaatatgtcagattatcttttttagacagattagttatgacttatatttgctaattgcttggattaaatagataattttcgtcaatttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaacccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgaggcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattgttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcgaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaatctatgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaattcgtcttactatgctattaaggccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaaatattataattttaaagaaaaatgcgctaagtctctcctagcgcattttttatgattatttttaacgattttgttcaaaaaataataccgttgctgcaacacgagaatgaacatttaatttacgtaataaattacggatatgtacttttacggtttcttctgaaataaacagttgtgctgcaatttgtttgtttgataagccagttgcaatttgacgaagtacgcccatttcacgatccgttaagctgtctaacggattatcttcgtgagtacgttctaataataaatttttaatagaatcactcagaatgacttcgccttgtgctatgcgcttgatttggtctagcaatgtatcaggttcagtatcttttaacaaataaccatctgcacctgcatcaattagagtataaatatcattttttgcatcagacactgttaaaattaaaattcgcgcatcaacgccttctgcacgtaatcctttgagcgtatctaacccagaaagtcctttcatgttgagatctaaaatgatcacatcaggtgatgtttgtaatgccacagaaatcccttctgtgccgctgcttacgtcagccactacttcaaagttatcgtctaattctacaagttgtttaatgccacgacgcattaacggatggtcgtcaatcaataaaacttttagcttatcttgcataatttctcctttagtggttagaagtccactttaaaaagcatgacattttataaagaattcaattctatgccaatctagaatagaaaaaaatttgatttatatcacaaacttactatttgaggtaggtttattgatggataaaaatagaaaaagtgcggtagaaaaatagataattttttaccgctcttttttaagataagaaatattaaatggtcgattctaatgcccaaagttcctgtaaggtttctcgacgacgaattagataggattgatcgccatctactaaaacttctgcagtgcgggctcttgaattatagtttgatgacatacttgctccataggcaccagcagaacattgagcaatataatccccttcagcaattgaaagttcccgttgtttgcctaagaaatcagacgtttcgcaaacaggccctacaacatcataaatggctttttctctttctaaagtgcggtcaatttcgacgatgttcatgtaagcctcatacaatgctggtcggatcatatcgttcattcctgtatcggtaatggcgaaattacggctttcattactttttaagtattgtacttttgctactagaattcctgcatttgcagaaattgctctgccgggttcaagaataatttcaagttcgggataattttttagtttttctaataacgcatttgcgtaatcgcttggatgcggtggtgtttcatccgtataagtcacgcctaaaccaccgcccagatcgagatgttttaatgtaattccatcttcttttaattgttccattaggacaattaatcgatctgttgcatctaagaatggttgtaattcggtgagctgtgagcctatgtggcaatccatccctgttatttttatgtttggtagcgttgaggctaatttatatacctctcgagcttcatttacgcttacaccaaatttattttcttttaatcctgttgaaatataagggtgtgtatgagcatcaacatctggatttacacgtaaagaaataggtgcgattttacccatttctcccgcgatttggttaatgtgcttgagctcagaaactgattccacattaaagcaacggattccaacttctaatgcgcgcataatttcttctcgagatttcgcaacgccagaaaagactacttttgacgcatcgccacctgctgccagtacacgctcaagttcgccttgtgagacaatatcgaaacctgaaccaagttttgccataatatttaacacgccaatatttgagcaagatttcacggcaaagcaaattaagtgaggacgcttaccgaaagctgagtcaaaagcgtgccaatgacgttctagtgtcgcgcgagaatatacataaagaggtgtaccgaattgttcagcaagttgttgaactggcatatcttcggcataaagtttgttatgtttatattggaagaaattcatgttgtgtgcctgttttagttattttgggaatgatattagataatagattattgagtttgttgagcttgatctttttcaggaaaatataaagaaccttttacgccgcatcctgttgtcacaatgcaaattgcactaagcactaaaattgatagtagttttttcatttttctctctctcacttatcggtaaatccgcctttcacaagcttgagaaaggctttataatttgccacattttatcagatttaaacaggaacattttatgaatattgcagaatttcaccaaaatattgaacaagtttggcaaaaaattgaagaagaattggaaaaccaaggtgcagatgtagattgtgaaacgcaaggttcagtatttacaatcacctttgataatcgcacacaaatagtgattaacaagcaagaaccgctgcttgagctttggattgcaagtaaattaggcggtttccattttgcttttaaaaatggcgactgggtttctaatgacggacaacgtttttgggattgtttcgttgaagcctgtgctgcacatggcgagaacgtgcagttctaaaatgctggattctcctttaccatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaaaaagatattctgcggcatcttaatctgaaaaatctgcacaaatatattggtagttttgatcgaccaaatattcgttataccttggaagaaaaatacaaacctatggagcaactgacacgttttgtgttggctcaaaagggtaagagtgggattatttattgcaacagcagaaataaggttgagcgaattgcggaaagtttacgcaataaaggtgtctctgctgctgcttaccacgcaggaatggaaacggcaattcgtgaacgtgtgcaacaggattttcagcgtgataatgttcaagtagtagtcgcaaccattgcttttggaatggggattaataaatccaatgtgcgctttgttgcccattttgatttaccacgtagcattgaatcttactatcaagaaacaggtcgagcaggacgtgatgatttgcctgccgaggcggttttgttttatgaaccagctgattacgcttggttacaaaaaattctcttcgaaaaaccagaaacgccacagcgtcagattgagcagcataaattagaagctattggggaatttgcggaaagccagacttgtcgccgtttagttcttctcaattattttggcgagcatcgacaaacaccatgtaataactgtgatatttgccttgatcctcctaaaaaatatgatggcttagtcgatgcgcaaaaagtaatgtctactatttatcgagtgggacaatgttttggtgcacattatgtgattgcggtgttgcgtggcatgcacaatcagaaaattattgaacgccaacaccataaactttcagtatatggcattggaaaagataaaagcaaagagcattggcagtctgttattcgtcagcttattcatttgggttttgtgcaacaggttattagtgaattaaatccaacgttgcaacttactgaaagtgcgaaagtgattttgaaaggcgaagaaccgttagaattggcaatgcctcgtatttcttcaatcagtaaaattgcccataatccacaacgtcaaggtgttgcaaattacgataaggatttatttgcacgcttgcgtttcctacgcaaacaaattgccgataaagaaaatattccgccgtacattgtctttaatgatgcgacgttgcaagaaatggcacaatatatgccgacaagcaatattgaaatgttgcaaattaatggcgtgggctctatcaaattagagcggtttgggcagccgtttatggcattgattcaagaacataaggcaattttggcgaatgcgcaaaataatgactaagtgttaaaagtgcggttaaaaatgaccgcactttttgttatacttgcgccaattttttcagttcttagaatttaaggttaaacaatgcgtacaagtcaatatttattttccaccctaaaagaaacgccaaatgatgctcaggttgtgagccaccaattaatgttgcgtgcaggtatgattcgcccaatggcatcaggtttatataactggttaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgtggaaaccgtaactttgtacttgggccaactcacgaggaagtgattacagatttagtccgccgagaagtttcttcatacaaacaacttccacttaatttataccaaattcaaactaaattccgtgatgaagtgcgccctcgttttggtgtaatgcgttcgcgtgaatttattatgaaagatgcgtattctttccacacgacacaagaaagtttgcaagcaacctatgatgtgatgtatcaagtatacagtaacatttttagacgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgccaagctccaaccgctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgagatcaaagcacaaaaacacccgttagtggcagatccccttgagtttgcggacgaaactgaaatcaaagcgaaaattggtgcgggcgtgggatcgttaggcgcggtaaatcttaatattcctgcaattattgaccgcactgtggcgttaatgtctgattttagttgtggtgcgaatattgatggaaaacattatttcaatgtgaactgggtacgcgatgtagcaatgcctgaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagcgattgaacagcatcatgatgatcgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggcgtgatgtttgcagacatggaacttatcggtataccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaatcagtattttattttgtatattgtgacaaaagagcggttaaaaatagccgctctttttgttgatctaacgtttatattgaacaatgtttaatccaaactaaatgctcgaatataaggtagttttcctttttctaacatctcttgaataccgctttgatggtcattgctgcctaacccccttaattctaaggttatgccaatgctattatcataaacaatttcattacgtgtttggttttggtggtttgtgacattgcgttttacaccaacacttgcagcccaacagcaactgttatattgaacgcctagatattgttctactggtttttgtaaggcgagatcttgataatagcgtcctactacagcccaattattggcaatttcccagcctacaactaatcccacttgttggatatcttgttgataggcgttagccgatttacctaagttttggtcaatatattcttggttcacatatcgataatttaactgaattaaattatttttttcaggattatattctagtgatgtattcgctaatgatgttgaattggtatgagtatcaaattgatagctaccacgccaataccatttattacttattttccaattagattctaatgcccaagcagatgatgaagttggtgttttattcgcagggttttcatcaatacgagaattacttaagtaataaatttgacctgcagataaattaaatcgttcttcgccagcaatatcataaaaacgcgttgtgccacccaaggtaacttgatttgccgatgaaattcgatctaaaccactataacggcgatcacggaatagcgaatagtaatcttgctgtactaatgctgaatcgtaaccaaatcccaaataatcattattaagtgttgaaccaatattgctttgatttcggtaaggacgatataaatactgcacgtgcggttcgaaggtttgtgtatactcttttaagaacgttatatcgcgtgataatacactttgtaaatcaactttaaattgtggaataactcgatttaccgttttttgcacgtcctctgcattttttcctgaaccttttttctgctcgtaacgagtcgcataaagtttcgtttcaatattcaaactgccgtatttatttgacattaaagaatttaggctaggttctgcatggaaacgccatgcagttggcatcaatttactgtcattatcaaaacgaactgcttgtgaatgtaatttgaaatttaaccatccattcgctaaatcatatttgtgatagttgaaatctaattgtggtactgcacggtaagggccgatgtttacaatatcatcaaaaatttggaactgatgtgcagaaagagaaaaattataatttggttgataataagctatgcgagcatattggttcgcataaccatcggtactgcgtccataaatagaatcaaagtcgttgaaataacgtttatcgcttactcgggtgtaattaatatttagacgccaattttgtaaaaagctagaattgtgattccaatagaacaaatgacgttttcgattatcactagcatattcagagtaacgatccttacctaaatattctcctgccactttaccttcgccaatggaggttaaatagcgaaattccccatttgcttgccaaccacggcgagacatatatttcggggtgaaagtaagatcataattaggagcgatattccaataaattggttgtgcataccaaagaccatctcggttagatgttcccgcgcttggaatcaataaaccagaacgacgacgatctccaatgggtaattgtaagtaaggggtataaaagacgggaacaccatgtattttaaagcgagcatgccacatttcagcatattcttctttcacgtattgacgaatttctgacgcatctacagcccaagcattgtcgccgtgcaaacatgacgtaaaggttgcattcttcattacacgataattattatgcagtgttatattatcagctttaccacgtccttgacgaccgacaaattcatattctgaatttgttaaattaccatcgtgactatctaaattaaactctgcatctttacccaacatattgatctgattatctttataatcaaatccattgcggacataagccatgcgtaaaggtgttgattggtttccagattgtttgacctgcacggattgtgctaacaaatggcgattgccttgtttcaaatctacattaccttgataggtcgcatcatttggctgattaatttctgcgttatccgcttcaatatatacaggcagagaattcacatcacccgtcacgacttcaccgctaaattttggcacgcccattaaacattgttcgtgcaaatctgccaaactttgttggctataaagtgcggtcaaaatagcaagtgaaattaaagtgtgttttttattcatcgtcttgttttaatttgtcagaaaattggtcagattatactggaaaaagtgcaaggctagtaatatttttcaagaagtgattattaatagaatatccactgggttatgattaaattttttgtctattgaaccatcaatacgccaagacagcccatatcttctaacattaaattcgataccccaaataagaatgggaagttgccagaagatgcttgatcaaatttcactaaaatttgagttttgttttttacccaaacggtatctttccaagctaattcttcagcttgtaattgatgttctccttggctttccaccacaaatttggcaccttgaatagtaaatccaacaggtaaacttgcatttaaaatccagcgttcaatggtgcctttacgagccataacatcaaccttgcgcgggtcaaaacgtctttgattaattaaaccgtttgtgacatcaatattaaattctcgagtttgtgcaacggcttgttgtaatattgctggtgcatccgtttcgaaagttagattcggttgtttgttaaatgcggatagttgtccttgagcacgtaattcaaggacggtgttattagcgagttcatcgcctgagaacaacatattttttattttttcgtacaagctacgtttacttccgctaatgagagatacgttgtcaatttcattcatattaaccagtatttctgcgcgttctcctggcgagagaaccaaagatttgactgatttcgctttgggtaagaaacttaaatcttgtgcaataagtagcatttcttgatcattatccaagcgtaaatcataagcacgcgctaatgaggcattgagcaaacgtaaacgaatccaaccccgtgcaacatctaaatatggtgcttcaataccattcactaataagcgattgcctacaaagtgcggttgattttgtttgaataattggagaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagacaaggcaacggattgtggcaaattgttatgataattaagtttggcaaagctacctgatttgattttaatggttgggccaagataattaccgttgaatccccataccgtcacattgtgtgagccatctaacggataattcgtttcctgcatggttaatacaatcgggcgaccgcgacgaacttcaattagtggcggcacaactagtttttcacggcttgccgctaacaatggtgctggcacggtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagctttttttacccacacttactgtgcgaggttgcaccatataagagattgttaccatatcataattattttgatgattaccgatataaatggcgcggctaatttgcttctgatcttgaggaatacgatgttctacctttaagccaaaaagtggatataagcgtccaaaccaacgagcaacaatgcctacgttgcttggatttttaaagcggataaaagaataaatcgtacccagtacacaaattagaatacagcagattaatacgaggaaaattcgaagtagttttaacataaggatgccctatacaaaatttcgttaaagtatagcaaattcaatatcaatatgtgttaatctaaacaaaaatcgtggaatttttatgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaagtgcggtaaagcaaaaactcgttattttacttaatgatactagaataatacttatccataaaatcgtacctaaaagctggtggataagcccaacttttagatacagataaaagtgcggttaattttaggattagttttctttcggtaagcgaagcgacgcgtaaattaatcctccccacaataaagtaagggctatgatcatcataataattgcgccagtagtcattttattctcctttagtttcatcaatcgttaatttggtttcgcttttccattttaagcgagaaaggaaaaatgccacgacaagtaagctaatcgacattccccaaccaaaggtatttacaaaccagtttggatagccttcgtaaccttcagagaagacttttgccccttcgctgaaaagcataaatgctaaaacaccactcgttaatacaatgcataaacgccagaagaaacccactttgaaagatgacgtttcatttaagtgattacccaataaaccgagtttttcatttgctacaatcgcaattaaagacgcaaatgctacggcaacaataccgaaatagttcacaaatttatcgaacacatctaacatcggtaagccagttgttgtaccgaataagatgacagaaactagcatcattggtacacccacgatgaatgtcacttttccacggctaatacgaattttatcttgaattgcggaaataattacttcgataactgagatgaatgaagtcaatgcggcaaaggttaatgcaccaaagaataacatgcctagcacttcgccaaatggtgctttgttgatgatggttgggaatgcgaaaaatgctaaaccaattccgccttttgctacttcgctaacttcttgaccttgcgctgttgcaataaaacctaatgctgcaaatacgccgatacctgctaacacttcaaagctactgttagcaaaacctacaaccaagccactacccgtcaaatcggattcttttttaagataagaggcgtaagtcaccataatcccaaagccgattgaaagagagaagaagatttgcccataggcggcaatccacacactcgggttggataattttgtccaatctggtgtaaataatgcatctaaaccttttgccgcacctggtaagaataaggaataaatcacaagcaccataaacatcacgacgagcactggcattaatacggaagagaccttagcaattcctttttgaacacccatagaaagcacgcctaaggcaacaatccacatcgcaattaatggtgcggttaccataccaacaaattcaaagctgataccgtttttaatatcgcccatttttaaaaattcaccgatgaagaaatcaatgggtttatcgccccacgcaccagtgaaagaaaaatatgtgtagcttgctgcccagcctaacactacagcgtaatataatccgatgatgacattcaccatcatttgccaccagccaaacacttcaaagtgcgggctaacacgacgataagaaagtggcgcaccaccacgatgacggtgcccaatggcataatctaggaataaaagaggaatccctgcggttaataatgcaataaggtaagggatgataaatgcgccaccaccgttttcataagtggtgtaaggaaaacgccaaatattaccaagaccaacggcagaaccaattgctgccagaataaatgcgcgacgaccagaaaaagtctcacgcttttgtgctttggagctgagtgcaccataaattatcctatgtaaaaaaatgaaaagagtttcaatataatgaaatctaacaatcagtcaataagcaagcttaaagagcggtaaaaattcactaaattttttaggggaagaacaggaatattcaaaataagccaattttcaccgcactttttttcgtttttttctctccaagccctaccaatgactcgaaatttcgctacaatgctaaacttatcccaaaataaaaataacaggaaacaaacacaatgacaggtgcacaacttatcatggcgtgcttgaaagcacatcatgtcacgactcttttcggctatcccggtggcgcaattatgccaacctacgatgccctttatgacgcaggcttagatcacttactttgtcgtaatgaacaagggactgcaatggctgcgattggctatgctcgctccacgggaaaagtgggcgtctgtattgcagcatcaggctctggtgccactaatttagttattggattaggcgatgccatgatggactccattccagttgtcactattgaaccttggcgtgaacaaatcagaaatttcaaagcaaaattagatttcacttatgttgaaaatcaaggcaatcgcccgattgatccttgggcattactcaacagcctatctaatcgcaaaccaaataatgcgataatttgtactgatgtgggtcagcatcaaatgtggtcagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaatcatacaaacgaaccctaaattttactcggagagattatttatgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaattgaaaaagcgggcggcgtagcaaaagaatttaacaccattgcggtggatgatggtatcgcgatgggacacggtgggatgctttattccttaccaagccgtgatttaatcgctgatagcgtggaatatatggtcaatgcgcactgtgctgatgcgatggtgtgtatttccaactgtgacaaaatcactccaggaatgttaatggcggcaatgcgtttaaatattccaactatcttcgtttcaggcggcccgatggaagcaggtaaaactaaactttctgatcaattaatccgcttagatttagtagatgcgatgattgaggcagccgatccaaatgtaagcgatgagcgtattgatgcgattgagcgtagcgcttgcccaacttgtggttcttgctctggcatgtttaccgctaactcaatgaactgcttaactgaagccttaggtttatctttacctggtaatggttctatgttagccactcacgcagaccgcaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgcgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgtgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgagcatcaaatgataacgaacgtttatataccttcgaattcccagagcaaaaaggtgccttattaaaattcttggaaaccttgcaaaatcgttggaatatttcattatttcactatcgtgcccacggtgcggactatggaaatatccttgctgggttccaaattgaagaacgcgaacaagcagaatttgaacaggcacttgcccaactcaattatgtttttgaagatgtaacagaaagcaaatcttatcgttatttcttacgttaatcttataaaaaggcgtgatatttttcacgcctttgtcttattcaaactctaattccaccgcactttcgccgagtaaattcaccaattccgtcagaatttcatctgttggaatgatcgaccattgcacgcctaaacgtaacaacgcacgacctttcggactttgataatacacgttaataggcaatgttccaccactcactggctcaagtaatgctttaaattgtttaatgaaacttggtgtaatttgatgctcagaaagactaatagccaaggatttgacataacgagaacgtgcctcatctaaggtcattaactcgcgcaccgtcattttcaagccaccagagaaatcatcaaagctcacctgccctgaagcaacaatcactgtatctttttgtaatttctcaccaaattgttctaggctttcaccaaataatgttaaatctaagcgacctgaacgatcgtccaatgttgcaatacctagacgattgccttttttcgtcatcgcaattctcgatgccacgactagccccgccacagtgctaatttgtccacggcgatttggtgcgagatctttcaaccgcgttgatgtgtaatgagaaagttctttcaaataacggctaacaggatggctacttaaataaagccccaaggtttctcgttcgccatcaaggatttgtttttcagtgtaaggtggtgtattagcataggcattttccacgtcttcatgggtttcagtcagcacaccgaacatatccgtttgtcccattgcttcatctttcgcatgctgatcggaagctctaagtgcatcttccaaattcttagaaagtgcggcgcgatgtgggcctaatttatcaaaggcacccgacataattaggctttcaaaagtacggcggttaatttttttcaaatctacacgagcgcataaatcgaataaatctttgaaaatccccccttcatttcttgccgccacaagtgcttcaatcgggccttcccccacgcctttaatcgcgccaatcccatacacaatttcgccttgttcattgacactaaaatggtgttttccgatattaatatctggtggcgtcacttttaagcccatacgcaaacattcgtcgtacaaacctacgattttatccgtattatccatttcagatgtcatcactgcagccataaattctgcagggaaatgagttttaagccaaagagtttggtaagacaccaaggcataagcagcggagtgagatttattaaaaccatagccagcaaatttttccaccaagtcgaaaatcttcatagatagctcgccatcaacaccgtttttctcagccccctctttaaacactaaacgctgttttgccatttcttctggtttctttttacccattgctcgacgcaataagtcagccccacccagcgtatagccagccaacacctgcgcaatttgcatcacttgttcttgatacaaaataatgccgtaagtcggctcaagaataggtttcaaacttgcatgttgatattctgcgtcagggtaagatacttcttctctcccgtgtttacggtcgataaagttatctaccatacccgattgtaacggacccggacggaacaatgctaccaatgcgataatatcttcaaaacagtcaggttgcaggcgtttgatcaaatctttcatacctcgtgattccaactggaacacagcggtggtttcggaacgtttaagtaattcaaaagattcaggatcatcaagtggaatggcggcaatatctactcgaggcttgccttcacgcaccatacgaacattaattatatccaatgcccatttaatgatagtgagagtacgcaagcctaggaagtcaaatttcacaagccctgcatattccacatcatttttatcaaagtgagtaaccggatgtaagccttcattatcacaatagagtggtgcgaaatcagtaattaaggttggcgaaatgaccacgccacctgcatgtttacctgcattacgtgtcacaccttccagcttgcgcgccatgttaatcaatgctcgcacttcttcatcgctatcgtaggcagtctgtaattgcggctcggtctcaaacgctttggcaagcgtcatacctggatctggcggaatcaatttagaaatacgatcaacgaaaccataaggatgccccagcactcgccctacatctcgaataaccgctttcgccgccattgtgccaaaggtaataatttgtgataccgcgccacgaccataggtttctgcaacgtgctcaatcacgcgatcgcgaccatccatacagaaatccacgtcgaaatcgggcatagacacacgttctggatttaagaaacgttcaaatagcaaatcaaactctaacggatctaaatcagtgatttttaatgcataagccactaatgaacccgcaccagaaccacgacctggccctactggaatatcgttatccttagaccattgaataaattccattacgatcaagaaataacctgggaaccccatttggttaattacatctagctcaacttgcaagcgttcatcatattttggtcgtttttctaaccgcacttttcatcagggaataaaaaaactaaacgttcttccaagccctctttggatttttgcactaagaaatcttctgtacttaaatcgccagttggaaattgaggtaagaaatattgaccaaggcgcaaagtcacactacaacgttgcgcaattaataaggtattttcgagagcggaaggaatgtctgcaaacagcttacacatatcttcttcactacgaaaatattgctgtgaggtataacatttcggacgtttaggatcgtctaaagtatagccatcgtgaatcgctacgcgaatttcgtgggcttcaaaatcctctgcattcaaaaacatcacatcattagttgcgaccaatggtaaatcacaacgttctgctaatttcaacgctgcttgaatgtaacgttcttcatttgggcgacctgtacgacttaatgctaaataaaaatgatcggcaaaaaattcttggtaaaaagcgaccgcactttcaatttcggctacgttttctttcaacaattttttacccacatcgccttgcgttccccctgataaaataatcacgccgtcgcgatgttcaattaaccaatcttgatcaatataaggtaaatcgttataaccgcgttgataagcctttgataacaataaagttcgattctatagccttcattatttttagccagcaaagtaagatcaaagtattcatcgccacataatgggctttttacttttacatctgccccgataatgggcttcatacccgaagaaagcatttcgctataaaaactaaccacaccacaaaaattagtaaaatccgttaatcccatagcaaccatttcattggcagcacaagctttcacaagaggttttactttgacgatactgtcaatcatcgaaaaatctgtgtgtgtgcgaagatggacgaagcgaggttggaatgacattgaaaatccttaaaatgcggttaaattttgccgtaaatattaaagcggtattatagcgaatttttcaaacaaatgcttatgctacaaatagtgttcccaaattggctcggataaccgattgcgtgaataaaaaatgttaattagatcaaaaaattgataattagccgttttcattttgttagattttcgctagtctaacggcgattttttatttatttcaacgaataaggataacgctatgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgcttacaatttggtacggcaggtttacgtggtcgtttacaagctggctcaatagggatgaaccgagttttagtttctcaagctgctggtggtttagcggaatatttaaaaggttacgataaagaaccctcaatcgtcattggttacgatggccgtaaaaactctgacgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttggctgtttcttagggtggtatttggcaaaacaatatcaaggcaaacaaggtacattggcttgctcacttgtttcttccccagctcttgctgaaattgcgaaaaaatacggtttccaatcagaagaaaccttaactggtttcaaatacattggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagattgcgtattggcagaatttgatgaaggtgttcgtcacattcttcgccaagatacttatggcaaataagactgctaattgcacaatgggatgtggatacgtcaaacggtgcattgacttgttgtttgcaaagggtgtggtatttggtcataaaaaatctgcaccttagttggttatttagtccagcttttggggtgcagatcatttctagcttgccttttgttttaccatttaattaatgtttagtttgttcttcctcagatttttcttctgcattttctgcttgttggcgattcatatattcaacaaacaatgcatcaaagtttactggagataagtttaatgcagggaacgtaccgcgattgactaggttagacactaattcacgtgcataagggaaaagcatattcgggcattgagaggttaaacaatgcgccatttgaacatcttctaaaccgctaatagtgaatacgcccgcttgttttacttcacaaataaatgcgacatcaccactatcttcaagtgtagtttcaacagaaatgtttaataccacttcatataagtcatcgccaacttgggttgtttcggtgcttaaatcaaaaccaagttttggtttccattcttgttggaaaatatgtggaagatttggagcttcaaaagacacatctttcacataaatacgttgaatttggagaacgggttgttgttcttctgttgctgcaacgtcttgtttttgttctgacattttctattccttattatttatgttttttaactaaaggtaaatttgctgctacccacgcggaaaggccttctttcaacacaaatacagaattaaaaccttgtttggttaaaaatactgcagaagcagaggctgaagtaccatttgtatcgactaatataagagctttctctttatgcgactctaattttccgatattttgatttttaatttcgcttggaagcacattaatactattaatgatatgtccacgttgaaattcttcaagactacgtaaatctaccacaatggcttcatcggaatttattaaccgaataacttcattgtgcgtaattactttaaatttactcgttgcgcctttgtagaaggtataaatcaccatcacgaaaatcgcaaaccaagaaactgctaaaagcgtatgtttttgagcaaactctgttgccattgagataaattcttgcattgttttctctactgattaagtacgtcaaaatagggctcaagtataaccgcacttgggttatctttcaaaaaaatattcaaaatatagaatacattaaattatctttatttcagctgatggaaaataacagaatttttcaacattatttattgatccaagttatggaatctctacctatttgttgctatattacacgccgtttcaacaaataaaataaagtgtttttctattaacttagggggtcagtatgtctgcaatgttcctcctgcaatttggccatcgtattactgtgtatcttagtgggtgcaagtgtagcgtggtatcggtttaggagtatttggtggtttaggtctcaacgttcgtttatttggtaaaggctttaatccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcagtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccactttagtcaaagaagtagaagtgagcaaaacagctaaaatttctgtttctttattcttatttggagctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaaaatgtgattcgataacaaagaacggtgctgaaatagcaccgtttttgttattctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttcccgcgttcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaatcgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagctaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcagggaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagtaaacgacctgtacgagaacgaccgccctcaataaaatattcgacggaatagcctcgatggaatagttctgataaatattcgcgaaaaatggcagaatatagtcgatttcccttaaaagtgcggcgaataaagaatgccccccaactacgaaacattctacctataggccagaaatttaagttaatccctgccgcgatatgtggcggaacaagaccttgatgataaagcacataagaaagcaataagtaatcaatatgactacggtggcaaggcacataaacaatttcatgaccttctaacgctaatttacggacacgattcgaattttgtacatcaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccaggagaacgtccccaaagaacagaaacaggaataagttgcacatctaaactttcagaagtgcggtgtaattcaagatatttattgaaaatggtagtggtttcgtcttttgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtggctgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgcaataacgcttggatgtaatctggtaccaagaatgaataaagtgcggtaaaaatttacggtatttttaccgcactttgcttatactagagtgctttatttgccatgatttttgctgctctttataatgcaaaaatcttgaatttatacaaaggatggaaaaatgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcctgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgataatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccacgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggaattatgcaaggcttattaaacaacaatgtccaagtagatttaccgggcggttcgctcatgatcgaatggaatggtgttggtcatccactttatatgacaggcgaggcgacccatatttatgatgggtttataactctttaatattttttccccatttatcttaaaaaaagatggggcgtttttcttaaattagcgtaaacattttgtatctaaatatatttttattgagctgtttgataactttaagtaatcagaacaagcatttttcatacaatctctagattttttacttaaagaaatagattattagcataataaaaaaccgcctctcggcggttcttgttttaaatcttttatctactacgctaacactgccaatgcagcttcatagtttggctcttctttaatttcttcactaactggctgtgtaaaacattgttttgttcatctaacacaataaccgcacgagaagttaaacctgccaacgggccagtttgaatatctacgcctaattgtgagtgtaatgcgtggttacggaaagtcgaaactgttttggcattttcaatcccttcagctccacaaaaacgagcttgagcaaagggcaagtctgctgaaatacaaagcacaacagtattacttaattttaccgcttgttggttaaatttacgtactgaagtcgcacacacacctgtgtcgatgcttggaaaaatatttaggactttgcgtttacctgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattatttccaccaattaaagctatccagaatttgattttcgggaaaatttcagccaccacacaataaccaatagcaaagactaatgaaaacagtatgtgcgttaccccaatccagttaaatccgtgaaatcaatagggctgctcggtggaaaaggatgctccgctccccatttaacgaaagcagagataaaacctgcaaaaaattgcaacgccataacgacgtttagatggttctgaaaataagctcattgttgtatccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaattgattgattttttagcggttgtagagcgagtataagctttgtattacttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgcgcacattttaatgaaagtggaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgtgcgttacttttaaaacggaatttacgtatttgtaaaatgaataggtaggggtataattatctaccataactaaacaaatcacatcgtttacgatttgtctttttataaataaatattttatgaaggcggaattatgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtttactaaacataaaagaattactgctacacaaaataagcagaaatttatcgttccatttaaataactatggagagattatgtttattacacctatcttcattattaatctagaaaaatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattgataaattgatatagtagacaaagcagttgttaatgtttatttttaaatattagcaactgttttattttggaattccacgcaataatcctacaggctcaaaaggttctatagaagttggcgcgggcacttcgctgaataataaaataaatggcttgtgcggaataactttttcatttcgccataaatttcccattccgactaattgaatatcttcgggtaaattacgaagtcctgcttgtaaaactgcaatcgtattttggcgaggatgacctattgcaatggcggagccgtgttttctagcatagtgaattgctgctttaaattgacgttgaacgtctgcgaattcgttactatcatctaaaaatatatggcgatctaatgaacgcacgccttgttcttttgctattttcccagctacagattttcctattgttcgactatctaaaaagaataaatgtttttcttgaagtgcggtcattaaataagtcattaattggggatctgccgtagctgcactccccatatgattgttcataccgatggcatcacgcacaatatttttagccgtattaacgcgatcatttacttgtgctgcagacattcctaaatgcagcccaccgtcttctattttcactgcacttactggttgcatcggcatatggattaaaatatctctaccttgagattttgcttcttgattacgtgctcgagcatagggcgcagcaggaataattgctacggaaatttcacgtggcatcgcaaaaattgctgcatcttctttggaatgatagcctacatcatcaatcacaatagcaagtttactttgagcaaaagaaaaagaggtataaagtgcggtagaaaaaacaatgaaattttttaccgcactttttatcagaatattcatcaacgaacccaccctgcaggatttactggcgttcctttacggctaataccaaaataaagcgcagaacgtgatatttcccctgtatttcctacttgagcaataacctgccctgctgaaacaagctgaccaactttcactgatacggcttgattgaagccatataaacttaaatcagtttcgccgtgtttaacaataaccatataaccataaccatttaaatatcccgctaaaatgacgcgtccagcagcaattgctttaacaggcgtgcctgctgatgcgccaattaccatacctttccaacgtacttcgcctgcttggatagaaccaaaagtatgcaaaattgaaccagaaactggtaaggaatattgtttttttgccgcccctaaaccgcttgtactattaagtaattggcgttcttgtacagttggttgataaggttttgatgttcgtttttcttcagctttttggcgttgagcaagtgcctctctttcacgtttttcttgttcgcgcgctgcttgttcagctcgttgaatttcttgacgaagtgcttgttcgtttgcttttagtgcattcaatttatcttgatctagggctaaatttttattgagttcattcagcgtagattgatgctcttgctgtgctttttgcaatgcttgttgttgttttttttgtgtggaaagttgatttcggtgattcttttgttgagagaaaatcgcctttttttgtactgcaatttgtgcttgcgttgcttttaaattattaatcatttcaatccgaacttgatttaaatgctgataataaactttcattcgctctgcttttgtcggatcttgggcaaacattcgttcaatcagcgatggattaatgcctgaacgataaattatatctatttgtttggttaatcgtgctttttgctcacgttcctgtttttctaattgtttgagttgcttatctgcatcggcaatttgcttacgaatttcctttaaacttatttctgtttcaagcagttcgccctcaacactgttaattttactctcgtgtttttttaaatttgcttgtaacttagcttgctcacgtttttgcttctctattttagattcttgttgcttaatttgtttttgaatttgattgagatcggaagattggctgacaggcgaaaatattaataaaccgcagcttaaaagtgcggttaataataatgatgttttttgattaacgccaaaacgcaacataattcatcctaaattcgtaaaactcgcaaatcttatcatatttgttaaaaggcgaaaaagtttgatggttattttttgctaaagatcaggaaatcatcccttttaacttttaaagctaaggattttttgctataaaatgcgcgttctttttatttgaaaacattaggagattcttatggaattagtatttatccgtcacggttttagtgaatggaatgcgaaaaacttattcacaggctggcgtgatgtgaatttaactgaacgtggtgtggaagaagcaaaagctgcgggtaaaaaactgttagacaaaggttatgaatttgatatcgcatttacctctgttttaactcgagcaatcaaaacttgtaatatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttatgacatttctccaccagatttagatccacaagatccaaattctgcacacaatgaccgtcgctacgcaaatattccatctgatgttgtgccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaattaagttcaacgtattgttgttctaactgtataaaacaaaaccccgcaaattagcggggtttttaaacaagtccaaattattttgtgcttggaattttgaaacggctgttgaaacgctcgacacgaccaccagtatcaacaacacgttgtttaccagtgtagaatgggtggcagttaccgcacacatcaagattgatgtctttgcctaaagttgaacgtgttttgatcacattaccgcaagaacaagtcgcagtaacttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattggtgcaatggtttgcacgcgaactaagcccaaatgcgatctttgtccgttaaatattgattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacatttagccattttcatttagatattcatccaatttatgctgaaatggagagcgctttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtgaatatctcaaaaaagaagcggaaggcttagattttcaactttatcctggagagttggggaagcgtatttttgattcagtaagtaaacaggcttggggtgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattagttatctatcctacaatgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacgataattgaattttttcagataatcaaaaatgctcgctggctaacaccattgagcattttttattaaaaaagtgcggtaaattttaaaatagtttttattatttcgttgttttaataaacatattgatgattaactattcaaacgaaatgttttttccattttttttgaatttagttattgaccgaaaaccgaaaaaatagtttaatacgccccgttgtcaggcagtagccaataacgataacgcctcgatagctcagtcggtagagcaggggattgaaaatccccgtgtcggtggttcgattccgcctcgaggcaccatttcctccttagttcagtcggtagaacggtggactgttaatccatatgtcgcaggttcgagtcccgcaggaggagccaaatttagaaaggccgctaaagagatttagcggctttttgctttcttatatataaaatatataatcttctctagtcttgtaactataactaggcatcaaaattcaaaatggtgtatcaatgagcgagagccttcttatttttgatgttagcaagcgacctaagtcgcttgcgtttaacttaaagaagaaaaatgaatcggcttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccacggaatacaccgcctaatcccgcaatgcgagttccttgaatatcaactatgcgattgtgtaaattgcgtgattgccacttagaaccccaaattgcattaaaagcactaatggttttgctatcatgatttccatgaataaaccaaatatcacaatgttgcgcaagtttatccaactcatctgctgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggagattcaatctctatataaggaactttatatttatctaacagttttttgagtagttgttgaaattgttggcgttgtttttgtgagcctaagctgcgcaagccatcatccacccattcagtattatttttaagtaaaatagtgacatcgaagggatattctttaatcattgagtctaaaaatggatgagcttttccttcatattgaatgcagaacgcttgcgtggtaatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggttgcggacacattaaagaaagtgcggtcaggatcgactaacgatacttctaaacctaagtatttctcgtaaggcgctttatcttgaggctcgctactaaatacgattgaaggttcaaaatgtttttcatgaaatagggttttaactgcttcactccaagattgccagccgtttggataacttggaataccgtcttcaatcaaatgatgaataaaaatctgatttttttgatatttgaaaatttgctgcatccaacgcaaacgatcttgcacggttggcatgcgtttcattttactatcgtaaaataatttcaaatcgcgcaccgtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatgaaaatatttttcacgttctgatttagtgcctaggtattttgcgttatacttagctcgcattctcagggcagggtgaaattccctaccggtggtaaagcccacgagcgtttaaaagtgcggtcaatttttggcaaatttttcctgcgaaattgtcctgattttcacttttaaagtcagcagatttggtgaaattccaaagccgacagtaaagtctggatgaaagagaataaaacgagttgggttcccaaatcgttcattttatttgcatttctcagccctgattctggtatttaattgaaatctcaaattaggaaattactatgaatcagtcaattttatctccattcggcaacaccgctgaagaacgcgtacttaatgcaattaatgctttcaaacatggaactggcgtattagttttagatgatgaagatcgtgaaaatgaaggcgatttaattttcccagcagaaacaatcacgtcagaacaaatggcaaaattaattcgttatggcagtggtatagtttgtttatgcattactgatgaacgttgccaacaactcgatttaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaaaacgaagaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataataaaagtgcggttaaaaatcttattaaattttaaccgcacttttttgtttattctacttctggtaaatttaccgcacctttatagcctaattgtcgccacgcttcataaaccgttactgcgacagaattggacaagttcatactgcggctattggctgtcattggaatgcggattttttgttccatcggcatttcatttaaaattgacatcggaatgccacgagtttctgggccaaacattaaataatccccaagttcaaatttcacttggctatgggctggactgccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctaggggttcaattaagtgcaagcgaaatcctgtattggcacaaaggcgaataatgttccccgtattttgtgggatttctggttcatataaaacaatatctaacataatttttctctaattctgatataaacgatagctcaccattcccgtcgttttttctttcaataacgtccagttttcaggagtaataagcggtttatctttctctgtttctacgtaaattaacgcattgggttttagccagttattttcacaaagcaaactaattgcttgttctgccaaattaaaatgaaagggtggatctaaaaacaccacatcaaagtgcggttgattttgtggctgttttagaaaatccaaactactttgattaattacttcagcctgttctgatgagcatttgagtgtttgtaaattcttttttaattgattggcaacggttttatccaattctaaaaaagtcacctttttcgcttggcgagaaagtgcttcaaaacctaacgacccactccccgcaaagccatctaaacattcagattgatagatataaggcattaaccaattaaaaagcgtttctttcactctatcgccagttgggcgtaagccttcagaatttaatacaggaagttttcgccctcgccatagtccagcaataatgcgaacttcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacggagttagccggtgcttcttctgtatttaacgtcaatttgatgtgctattaacacatcaacctccctcaatggggatnccntagaagtngaacctgcagggcatgcaagtcataggc

SEQ ID NO: 683 - DNA, 191996 bp, H. influenzae
ccaaatagagtgttattatgaaaaaaacagccgtgttaagtaccgtcgctttcgctattgcattaggttcagcatctgcaagttttgctgcagataatcgtattggggtaacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcatccagatgcggaagtgcgtacaaaatatgttgtagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcgcacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggcacaaaatgggaattaaaagaccgtgttgtacgcattccttatgttggtgtggataaagacaacttaggtgactttttaaaataattttccatcaatttttgttgtagtctaaggggaagtggatcttcccctttttaaagaggttggatatgacagctcaaactcaatgtcaagacagccaagtgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataaacataaggaatgaattatgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttgtctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctattgggggtaacccagaagcagctaaagtttcaggcgtgaatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaactatccacgttaaacgaacaacaaacatcagcaacttcagataatgctaaagaaaataacagggttcaaaaagaacaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcagctctcagaagatgaaatcaaacagtggaaaatcgcctttttaaatcgcttttttgataatgaaaacactgattttcaaaaatggcgtgatgaacaaatccgacaattacagactgataatttaaccgaacgccgtttacgaatggctatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgtcaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgtagcaaaagcgtggggttacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgcgaggggcttaatgcaacttttgccaagtacggcaaaattgacagcagagaataatcaactaccttatcaaggcgaacaagatttattcaaaccattgaataatattttgctaggtaccgcacatctgaatgaactcaatggaaaatatcctaataatcgaatattgattgcagccgcttataatgcaggagcaaatcgagtagaaaaatggttaagtcgcgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaaatgcactagtttaatagtgtgaaatgggagcataattatgtatatcagccgtaatttagagcaatggaatgcatttcttcaaatgctaaaaatcgcctttgaagaaaacaaagcacaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggcgattttcgatatcaaatccaatataactgggtcagcctagaaaatatctctccaaacattcaattagctgtgatttcatcagaagatcagcgtttttttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagcgatttataaaaaatgcaatcgaatttctaaagtaaaacaaactaaaaaatatttacttaatatataaaataaaaaacgagtctaagactcgtttttttatttataacatttttattacaggtttattaccgcaaataatacccaaacggtataaattgtggctaaaccgtaaaagataaatccaccagctggcacatgtactttaagatcgtgcataccgtgatgaatacggtgtaaaccacaccacattgggaaaatagtaagcactaaaataactaatttaccaatccaagaataagcaaaagtaattaaattatgcgcatcgactaaaccaaatggtaataacaaaccgatgattagaataacgacaggaagaaaaattgcactcactgtgccacctgcaccgaacattaaccatactggcggttcgccggagcgttttggattttgatcaaccattttttctctcccttaaatataaactaaaactaacgcaatcacgctaactaatgtggttaccgcccaaagtgcatttcttacaacagtgtgtggtaagcgttcatttttcacaatgatattcatcacttttggtgtcattaagaaatatgtcaccgtatgataaagcgttgcgataagcgtaataatatttaagaacaccacaatagggtttcttaaaaactcaataaagctcaatatgcctaagcctggcattggattgcttgcaagacaaagaacaccataaagcaatacaatacaaaaccatacagcaaagactgaagtcgcttcacgtagcatataagctttgtagaagtccaatttttgccaccaagtcgctgtcattggacgaacatattttttacgtttactcactgttactgacattccttcccccttagccttttggttttagcatagagataacataatctttggcactttccactttgccttggttaattgcagaagcaggatccacatgttttggacaaacttctgagcaatagccaacgaaagtacaactccaaaccccgtttttaccatttaataatgacatacgttttgctttaccatggtcacggttatcaagattataacggtgagccatcgtaatagctgcagggcctaagaattcaggatttaaaccaaattgagggcaagcggcatagcataaaccacagttgatacacattgagaattgacgatatttctcaagctgtgctggcgtttgtttagtacggctaacttgcaattctttcgatggatgtggtttaccatctaatgctggtgcttcgttaccaataatataaggcttaattgcctctaaactttcgataaagtggcttaaatcaaccactaagtcacgttcaattgggaagtttgctaacggctcaatacgcatatggccgctgtaatcacgtaagaacgttttacaagccaattttggtttgttatttaccatcatcccgcaagaaccgcagatcgccatacggcaagaccaacgataagaaagagatggttcaagtttatccttaatatagcctaacgcatcaagcaatgaagtttgattatcataaggtacttgataggtgcttaaatgtggctcttgatcgatttcaggattgtagcgtaatacttcaacattcattactggtgaattagccatttgcttgctccttagctttcgcagctgcttcttgagcttctgcttccgcaccgtaaacacgttttgcaggttgagatttagtaattttcaccggactgtattcaatgcgcggcgcaccattctcattgtagaaagcaagtgtgtgttttaaataattgacatcgtcacgttctgtgtaatctaagcgttggtgagcaccacgagattctttacgttcaatcgctgaatttgcaatagattgtgcaacatctagaatgtaacccaactcaacggtgtaaagtacatctgtattgaacacgcttgaattatctgatacgcgaatacgtttgtaacgttcttttaactctgcaattttatctactgctttttgcatacttgcttggtcacggtaaataccacagccttcttccatcacggtacccatttcatcacggatttcagaccaagattcattaccttcttgtttgtgaagagcttctaggcgagcaacaacatcttttgcttgagcatcaaccgcactttgatttaccgattgagcttcaactgcacgttgtgccgcatattcccctgcaacgcgacctaacacaacaagttcagctaaagagttagatcctaaacgatttgcaccatgtaaacctgaagatgcgcattctcctacagcaaataaacctttgatacgtgtttcgctattgaaatcgacttcaataccgcccatggtgtagtgaacaactggacgaactggaattggttcatttactggatttacaccttcataagcacttgctaattcacaaatgaatggcagacgctcatgtaaatatttttcaccaagatgacgtaaatctaaatgcaccacatctacgcctttcgcagtttttaaggtattaccttttttccattcttgccagaatgcttgagaaaccttatcacgagggccaagttccatatatttattttgcggtttgccaattggcgtttcaggacctagaccgtaatcttgaagatagcgatagccatctttattcactaagataccgccttcgccacgacaaccttcggtcattaaaatacccgtattaggtaagcctgttggatgatattgaacaaactccatatcacgaagtggtacaccgtgacgatatgccatagataagccgtcacctgttacaatgccgccattggtattaaatttaaatgcacgacaaccaccaccagttgcaataacaaccgcattggcattaatttgcacaagcgaaccttccatcatgttcattgcaaccataccacgagcatggtcatcatcaacaagaatatctaatacgaagtgttcatcaaaacgttggatttgtggatattgaatagaagtttggaaaagcgtgtgtaataagtggaaacctgttttatctgcagcgaaccaagtgcgctcaattttcattccaccgaaacggcgtacgtttacatcgccatcagctttacggctccaaggacatccccaacgttctaattgagtcatttctacaggggaatgttgcacgaaatattccactacatcttgctcacaaagccagtccccaccagcaacggtatcttggaagtgtttatcgtaagaatcttcttctttgataactgccgctgcaccaccttctgctgctacagtatggctacgcatcgggtatactttagaaactaatgcaatttttaagttaggatttgcttctgctgcggcaatcgctgcacgtaaaccaccgccaccagcaccaacaatcgcaatatcgacattaactgtttgcacgatatcctccaatcaatagaaagtaaaaataaatcccctaaaagggtaatattgtgtgggcattgtgccattttttgttacaaattaataacgttttttatgtctaaagatggaaaagatcgtattttgtgatctacctcaaaaaagctaagattgagttgagagtagctctcgtttacaatgtgcaaaatttttaaaacaggattaaaaatgaccgcacttaatcattggcaaccttctgccgatataaaaaatcttcttaaacgggcaaaaattattgctgaaattcgtcaattttttacagaacgcggtttgcttgaagtagagacccctgttctaagtgaatttggcgtcactgatttacatctctccacctttagcacggaatttcttgcgcctttcggtgaacaatccaaaacactttggctttctacaagccctgaatatcatatgaaacgcttgcttgcagcagggagtgggccgatattccaaatcagtaaagtgtttcgcaatgaagaagctggaaatcgccataatccagaatttactatgttggaatggtatcgaccgcactttcatatgcatcgtttaattaatgaagtagatgatttgctccaacaaattttagattgtccacctgcagaaagtttaagctaccaatttgttttccaagaatatgtaggcttagatcccttgtcagcagaacgttcagaattaattgaagcagcacgtaaacataattttatggctgaagataatgaagatcgcgatacgttattacagtctttatttattgaagcccttgagccttcaattggaaaagaacgacctattgcacggtatcattccctttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaaaggtaaaagtgcggtaaaaattgttatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtgactaaagcgtatccttttccgcgtaaagttttaaaccaagagggcttgttttttcgttctggtaatttgcgtcttaaattagagatgtgcatatcaagagaacggtcaaatggagtgagtggtttttccatcacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgcggtattatttgaaggagatacactacgacgcaaaatcgccttaattcttgcaataagctcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgcggtgaaaataaaaagattatttccagaatttccaccagcttgattttggtttctcacctgtttcaataatggtgttattttcgccttgttgtgaaacctgtggtaaaggtttatcaagatgggtttctgtcacaatcccacgttgatcaaattttactgtgaaagtatgttgaactggcgtttcataggcacgttgttgtaagaatacgtagtaccaagtgtagttattataagggtcgattaatattggtgttcccaacaaatattgtacttgttgagaagtcatgccttctttaacttgcgcaacggtagtcgcctctaaatagttgccttgcggtacatcaattcgatatacaactttttcaacggtggaacaagaagcgaggcttaatgctaaaaaggttgcgcctaaaagtgttttaacttgcattttctttaccttaatttgtgcaaaagttctgtcaaataatatccaaaattgggtgtatttccaaattaattctctgattgtaaagccttttgtaattgatcttttaaatttggtggtaagcctttgatggttagggtatctgtcataggatcccattgaatacgtgtattcaataattccgcatcaaaacttagggtaacgccctttcctgacccagagaattttgttagcgatttcaatgttgaacgtattggtggaatactctcttccaaaccataattctgttcttccgtaaagacgacaaaaggctgttcgtttagagtgggtaatgaatcagaaagttcccttaattcaatattgttaccatttgaaagctgacctttacaatattcaaacacttgtttttttaccgcttgagtttgctctttgttgagttcgccttgatcgcagtaatcactcacagcttgcaataaacattgattttgaacttgtggatttaatccttcttcggcacctaaaaaatccataaaaaaatcactaattttgcgaccaacacggccttttataaaggttaaataacgattagagttcgcgtttacttgcaaatccgtcaaatttatccgtgccgcaatatcaaactgagtaatatccaaatattctgtacggcgaatatctaaatgctcatcgactaacatactatgacggctatcaagcaatgcaataaacaaataatctgtcgctaagaaattatattgacataaaatcaaggtgccactttcagcaaagttatatttacctagctcatctgcaagcaattttgttgaatattgactaaaacctaaaaattcaatttcttgctctaataaacgatttaaatgttgtgcaaatatagacttttcctgaaacacgccaaaagccttagctttattttgatagccttgatgcaattgcaacatcatttgttctacttctggtgtaatggacagcaactcgtcgcgtaatacgctttccatttttatactgtcgccatccacatttttgactaactgatgcaaaacaatttgattaacggtaatactcatttttgtcacctttgaaaaatttgccgcaaattataaccgcactttttaagcaagaaaaaagaaattatttaggttctaccaaataatcgggtatcataagccaaattttttttatttttaacattatggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaatatgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaaattacgtagtcttgaacgccaaaaatggctaaaaggcactggtatattcttaaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagcgtattaaaattctcgaagttaccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcactttttgtcttttctagagctgttagcatgccacttaatggcccttgaaaatcgggcagttcatcggagaaaacaggaaagccaaattttgcatattctgtttgatttcggttagtgttaattgaaatctgatgaatttgtggttgtaagcgattaataacatgttcaattaaagattgtttacctaaaatctgtaatcctttatcttgcccgcccattctgcgtgctttgccacctgccaaaattaccgcacttattgtaattgtcatattttaatctatcattatttcaagtatcatttgcctattttttacgattaaaacggaaatagcaatgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcatttttgtaaaatcttatagcagaaaattagggcaacaaacagaatttcagcctgttttattgcgcatattatcttaagttttttattcgctttttattatttctgcgatctagatcgcaaactataaagctagttatttaaattacccattgaaaaaagctctttagaggcttggtcaaacttagtgatgatgtggcaaaagttgctattctagcaatgcctgttatactctatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgtagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgatcatcgcttattctttagctgttgcattatttattcctcttaccgcttgggctgcggcaaaatttgggacattgactgtttttcgtggtgcagttttcacgtttattttaggttcagttgcttgtgccgcggcctctaatttagagagccttattttagcccgagtgattcaggggataggcggtgcctttatgatgcccgttgcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgtgctaggaattttggcatcgggcagcgtgatgaacaatatcaagggcaaggcagagaaattagattggacaggttttttactctttgcattggggttagttggtattacgcttggtttggatttactcggagaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgctaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttaacgcaagtgattgcttacaacaggcattcagctatacttttttaacttcatcactttttgtaatcgcccttgtttggtcgcttatgaaattacacaaaaatgatggcgatcatttacgaaaaatgccttagattaatttgttataatccatagaatttttttatttgaaaaaagggaaatttgcttatatcttattgatatttcttgttggtggagatagctccatcgtttaaccataaatggtagggcattccctgcctaacattgaggtatgcttatgaaactaaaagcaacattaactctcgccgctgcaactcttgttttggcagcttgtgatcaatctagcttcggcaaataaatctactgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagctgggaaattagcgatgatggtttaagttatacttttcatttaagaaagggtgttaaattccatacaacaaaagaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataattcatattgatttacttattttaagcccttatttataagggctttttatttatcaaggattattctgtaaaaaatatgttaaataactttaacttgagtataatgctctgcattatttctatcggatatgattccgtagaataataaaaattaattgttaatataaggaacaaaaatggatttcaatcgaattatcactcatatgaatgatcatcatcaagatgatatggctgccctttgtaaaaaatttggtggcgaaaaggaaatcacagatgtgacgttagttaatgtagattttgctggtttagattttaaatataatggtggcaaaacattacgtgtggaatttccacaacaagctgacgcaggttcaattaagcaagctatcatcaatctttgtgtagaaaataaaccagtagcaaattacgatcgtattaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggtcgttttgtaagaggttttggccaagcttatttgattgatgctaatggggaaatttctcatattggtgtcaaaggcaatccacatgaaaaagaaagtgataaataatattgtctcttaatgaagataaagggttgagtgtaaatttatactcaccccttttgtttacgataagttcgagtgaaattgaaatttctttatttttttaccgcactttattttcattaaggacaaggcttgcttactataatttcgataacctgtctgtcgatatgctgcatactttttgatgcaatagcgcagagattatcaatagttcgatcaagatcgtgttcgacaataccttcattgccgcagcaataggcaatccaaccatacctgttcctggcactgcaacgcccaatccatttttcatcagattaggcgaaacttttacttcaatgcgttcaggtgttttgcctaaatatttcgccgctgtagcagatgcgagtgcaagagaaatgggttcggtacagcctagggctggcacaacatcgtgtttaacgatgtggagtaatggtttttcaatttcgttaagtctttctaaattcattcttacttatccaattaatgcgcttcatcccaattttgacctacaccgacttctacgatcaacggaacaactaattccgatgcatcttccatttgttgtttaatttgttcacggaaaaactcgactttttctgaccgcacttcaaacactaattcatcgtgtacttgcataatcatttcaatgtcgggatcgtgatagattacttcatcaagtttaatcatcgctcgtttaataatatccgcagctgtgccttgcatcggtgcatttatcgctacgcgttctgcccctttacgacgcattgcgttgctagaattgatatcaggtaaatataaacggcgaccaaataacgtttccacatagccttgtgctttcgctttttcacggatatcggtcataaattgctgtacactcggatagcgttggaaatataaatccatgtatttttttgcatcaggacgagaaatatcaagttggcgtgaaagtccaaacgcggacatcccataaattaagccgaaattaatcgctttagcattgcgacgttgctcgctggtgacttcatctaatgatacaccgaagatttcagcagccgtggagcgatgaatatccttgccttgagagaaggcgttaattaagccttgatcgccagaaagatgtgccataatgcgtagctcaatttgagaatagtcagcagcgacaatagaataaccttcacgtgcgataaatgcttgtcgaatacgacgaccttcttcattccgaatcgggatattttgtaagtttggatcacttgatgataaacgtcctgtcgctgtcaccgcttgatgataagaggtatgcactcgtcccgtttgtgagttgaccatttgaggcagtttatccgtgtaagtggatttaagtttgctcaacccacgatgttcgaccaaaattttgggtaattcgtggctataggctaattcttccaatacttcttcattcgttgatggcgcaccttttggcgttttttgtaaaataggtaggccaagtttatcgaacaaaatttcttgtaattgtttggtggaagccaaattaaatggctgacctgctaattcgtaagcttgttcttcaagtgcggttaatcttgtggcaatttcgttagattgcataaagagggcattactatcaatcaaaacgcctgtacgttccatgcgagaaagcacatgaagtaatggtaattccattgttttatacaattcaacaagcgttggttcttgttgcaatttcaaccacagtgcttgttgtaatttcattgtcacatccgcatcttctgctgcgtattcagtggcttgttctaatggaatttgattaaacgtaagctgattttttccttttccagcgatgctttcaaatgcgatagtttcatgacctaaataacgtttggctaaatcgtccatattatgacgacccgtactatttagcgtataagaaagcaacatcgtatcaaattcaacaccttgtaattcaatgccatgacgggcaaaaatgctttcatcaaatttaatattttgtccaattttgtgaatgtcaggattttctaaaatgggtttgatagccgcaagtgcggtcgatttttcgagtgtttttggcgcatccaaataatccaattgcaatggtaaataagcggcttcgccattttcaagagcaaaagatatacccactaaattagcagacatataatcgaggctatctgtttcagtatccactgcaatgagttttgctgtattgagtttttcaatccagcgcgttaaatccgcttgagtgagtaaggtttcatattttgtacgatcgatttgaattttaggcgtattttccaccgcactttgatcttgtgaggtcgcctgatactggttcattttcactggctgttcagtggtttgggttatggagtcagcaccattcatcacttcattaagccagcgtttaaattcgtagcgagcaaaatattcaatgagttgatccttttggctttctccaagcaacaattgatctgttgtcacgttaagttcaacatccgttttgatggttgctaatgtataagaaagatcggcattgggtttttcagccaataatttttcacctagttttttcgccccacgaattggcagttccgctactttttcaagattggcataaatttcagccatgcttcctatgccttgtagtaaaccaagtgcggttttttcgcccacgccagcaacgccaggaatgttatctgcactatcgcccataagtgcgagataatcaataatgagttcaggtggaataccgtatttttcaatcacaccctcacgatccaataggctattattcatggtgttgatgagcataatattgtcatccaccaactgtgccatatctttatcgccagtactaatgagcacttttttacccaaacttgatgcttgtagtgcgagagtaccgatcacatcatctgcctcaatcccttccaccactaaaagcggaatgcccaatgcacgaatcatatcgtgcaaaggctgaatttgtttgcgtaaatcatcaggcattggcgggcgatgagatttatactgttcaaacatttcattgcgaaatgttttcccttttgcatcaaaaacaacggctatatgagtgggctgtacttgtgagatgaggcgttttaacatatttaacacgccgtacatcgcgtttgttggctcacctgcggcattagttaaagaaggaaaggcatgaaatgcacgatataaataagaagaaccatccactagcacaagcggatttgttgcaatttgggccataaaaatctcgttttaaactgaaaaatgtgggcattatagcgtaatttatggtgatgagcgaatggcgggtttaatgtaaaatttatgacgaatattttttgctatggcataatatcagccattcaaatatttaatttaaggaaatcaaatgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctctctattgtggcactcaatttgagttttgaattaagccaagaaaaaaataaaacggctaaaattgaagaggtattgagaacgggtatccaacaattagatcattcattagaaaatattcgtgttacaaaagaaccgcattaaattaatgatcaaattagagtcattttgtcgttttataagcaactcgttaaatttgacaaataaatgctagtcaatactgggaatttgggctagtataaacccataagaattacctggagtgttcgtcagtaggctatgtccctgagccgatactttaaatcttataaattggtttcctatcgttggtgtgtaggcttaacctttgactcgttcattgggctaagaaacctgaaaacggtatcaactgatttccttgaaccgtcgggttcaaggactactgcccgcagcggcactctgggtcctatcttctcctttcatttctatgaatactcaaaaacgccagcaaatccgcgctgaaattcgaaaaatacgcgcaaatttaaccgcacttcaacagcaacaagcagcacaatcagtgacccaacaggcgttaaatcttatcgagcaacgacaagccaaaaatattgcattatatttttcttttgatggtgaaatttcaacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataagtcttttattccagttggtttagcgcaccaatgtcagcaagtagaaaatcttcccactgagcattgggatgtgccactgtttgatattttggtggattaaaacctatcatcaaaatcttattgatagataaaatcaaaatatttcattttttctcttgaaatttattcaaccgagcttacttagtttatgcgaatggcgaaagccgaaatcaaattgaggaaagcgtatgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggctatgtcggctatgaagaaggcggttatttaactgaggctgttcgtcgtcgtccatattcagtgatcttattagatgaagttgaaaaagcccatgcggatgtattcaatatcttattacaagtattggatgatggtcgtttaactgacgggcaaggtcgtactgtggacttccgtaatacggtggtaattatgacctctaacttgggttctgatttaatccaaggtaacaaagacgaaagctatagcgaaatgaaagccttagtgatgtcagtggtaagccaacatttccgtcccgaattcatcaaccgtattgacgaaactgtggtattccatccgcttggtaaagagaatattcgtgcgattgcaagtatccaattagaacgcttagcaaaacgtatggaaactcgtggctatgaattagtgtttaccgacgctttattagatttcattggtgaagtggggtatgacccaatttatggtgcacgtccattgaaacgtgctattcaacaagagatcgaaaacagcttggcacaacaaattctatctggtgcgttattacctggtaaggttgttaccattgattacgccaacgcagaagttcaagctagacaataggtattaaaaaaagtgcggtaaatttaccgcacttttcttatgaacctaaacgctgacgtgcaatttcaaataaacatacccctgttgcgacagatacatttaatgatgaaactgaaccagccattggaatactaatcagttgatcgcaatgttcacgcgttaaacgacgcattccttcgccttcggctcccataacaagtgctagtggtcctgtcagtttgctttgataaatggtttcagtggcttcgccagcagtgccaaccacccaaatattatggttttgctgtaaatcgcgcagtgtgcgagaaagattggttacacgaattaacggcacggtttctgccgcgccacaagcaactttacgtgcgatagatgttaattgtgcggatttatctttcggtacgatcactgccactgcgcccgctgcatccgctgttcgcaggcaggcacccaagttgtgtggatccgtcacgccatccaaaactaataaaagcggattttgtttattcgcaagaatttcatcaagatcattttcattaagttcttttgccgcttgtactcgagcaatgacaccctgatgaacctcaccatcggcttttttatcaagtgtttgtcgattaacaaattgcacaccaattcccagggaataaagctcatttaagagtggctgtaggcgtttatcttcacgtcttttaagtacgaagacttcaattagacgctctggcgaatgggttaaaatactattaaccgcgtgaataccgtagatttgttctgacataaatttctctttttcttatttgaatttttaattcatttttacaataggaagtgaattattttcgttttctagatgctttcttcaaaacatctttcttttttaccgcactttttcgtttctgggatgttttagacggtagttctttaaagactttcttggctttttctttcgccgtttttccagcacgacgaggtttacgttcactccccatcagcgagaaatcgaccattttattttctaaatgtactgcttcaactttgatacgaactttatcgcctaagcgatattgcattccgctattttcgccaattaaacgctgttttgctgcatcgaattggtaataatcgttttctaaggtggaaatatggactaaaccatcgatgaataaatcatctaagcgtacaaataaaccaaatccagtcacagatgaaataacaccgctaaattcaccgccaacatgatcttgcatatattcgcatttcagccaatctgccacttcacgagtggcgtcgtcggcacggcgttccgtcattgaacagtgattgccaagtaaatccatttcatcaaaagagtaatgataaccgcctgtatcggtggttttacgttttgcgccttgttctttagcgagtaaatacttgatacctcgatgaagtgttaagtctggataacggcgaattggcgaagtaaagtgtgcatattcttccaaagccaaaccaaaatgcccaatattatcagcatgatagacggcttgacttaatgaacgtagcaacattgtttgaataagttcatgatcatgtcgttctttaactttttctaagagagcagcatagtcttttgtggttggcttcaatccaccttctaaggttaaaccaaactcacttaagaaagtgcggaacgatgttaatttttcttcgctcggggtggcatgaatgcgatataatgcaggttctttatgtttttccataaaattagctgctgcgatattcgcaagaatcatacattcctcaatgattttgtgggcatcattgcgaacaacgggttcaatacgctcaattctccccattgcattaaaaataaacttagtttcaatggtttcaaaatcgatcgcaccacgttgatgacgtgcaccaagcaacgcttgatagagtttataaagatcttctaaatgaggcacaagcgtagaataacgagcgcgtaattcttcatcgccttcaagcatttttgctacttttgtataagtgaggcgggcgtgagaattcatcactgcttcataaaagcgataatctatgagcttacctttggcagaaatttgcatctcacacaccatacacaaacgatccacttgtgggtttagagagcataagccgttcgataaaatttcgggtagcataggtacaactcggttcggaaaatagaccgagttaccacgattatgcgcttccacatccaaagcggaacgtaaacgtacgtaataactaacatccgcaatcgccacccaaagtttccagcctttgccgtgtttttcacaataaacggcatcgtcaaaatcccgcgcatcttcaccatcaatggtcacaagcggtaaatttcgtaaatccacacggcctttttttgcttcttcaggcacttcttcagtgaatttttttacgtatttttccaccgcacttggaaacttatggggaatatcgtggttacgcaaggcgatttccacttccatttctttcgccatattatcgcctaggatctctgtgattacgccaattggctggttaaaactggcagaacgttcttgcaactcgacaaccacaacttgtcccatgcgagcaccattacgatgttcatttggcacgagaatatctcgaccaattctgctgtcatcaggcaccacatagctaaaaccgttttctaagaaaaaacgacccacaatttgttttttacggctttctaatacgcgcacaattcgcacttcacggcgaccacgacgatctaatccagcaagttgcgctaagacaaaatctccatgcatgactctttgcatttgatggtttggaatgaataaatcatcctttttgccatcgacctgtaaaaaaccaaaaccttcgcgatgaccaattaccgtgcctttaaataaatctaatttttctggtaaggcatagcgtttacgtttggtgaacactaattggccatcattttccatcgcgcgtaatcggcgacgcatcgcttctatttgctcttcatttcgaatggaaagtgcggtcaaaatttcatcccgattcatcggtgcattattgtctcgaataacgcttaaaataaattcacggctcgggattggattgccgtatttttccaattctcgtttgtaatgaggatcttggctgattaagtttttacgtttttttgtcattattttttacagttttaaaaagtgcggagagtttgacactgtaaggaggataatgcaagacggggataaaattatcactgtatattttaaggatattttaaaattgaagaacttaacgatctttccccagcactataacagtgatgactttttatagatatttttaaagtatgaaaagcgcggtaaaaattttatgcaggaacgcgttctgttacgagcatttgtagttttcgtaaaataacatttaatactacgccataggctggtacgaataatataatgccgacaaatagcttaaataggtaatctacaaaaccgagttgtgcccagtgttcagccatgaacggatctgcactttgatagaaggctacactgaagaaaacgaatgtatccgccattgagccaaatgtcattgagctagttggcgccacccaccaagtttttaactggcgtaagcggttaaatacgatcacatcaagcaattgtcctaccacgtaagcggcaaagctcgcaatagcaatacggaatacaaacagatcaaaatgcgttaatgattcgaaaccttggaatttgctttcagagaataaaacagatatgacgtaacttacaataagtgcaggaaacatcaccacgaagatgatttttctcgcatcttccgcaccgaaaatgcgtacggttaaatcggtagctaaaaagataaatgggaatgtgagcgttccccaagtgctgtggaaagaaaaatcgtttgctgcaccaagtgcggttaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggctgaatatagggagctagatgatacgcatatttctaataattgcaagagtcgattgcatttgagttttatattttatgaaaattgacgaatgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttagtaaattgagcataaaataaccgcactttagttgtatcccaaaagtgcggttaattttttctaaattttagcgtttagctttatttattaatgcgtgctagtacttgttgttgtacgatttgcacgtttacgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaaccttggtgttgttcttccacatcaatagttacttgttcgtatggctcttgttttttaccatcaatatcacgatagattactttagggcgagaaacggcaagctcataaccttcacgacgcatattttcgattaacacggaaagatgtaattcgccacgaccagatacacggaattcatctgggtttggggtttcttctacgcgtaatgccacgttgtgaaccaattctttatttaaacgttcaagaatttgacgtgatgtgacatattttccttcttgtcccgcaaatggagaggtatttacacagaagaacatggttactgttggttcatcaaccgttaatgatggcagtgcttcaactgcgttgatatcacaaatcgtatcagaaatatttaattctcctaaaccagtgatagcaacaatatcgccagcataagcaacgtcttcttcataacgttgtaaaccaagatgtccaagtacttgaccgatacgaccttgacgagtttttccttcactattgatgatagtaacaggttggtttggtttaatcgaaccgcgcttaatacgaccaataccaataacgcctacatagttgttgtagtctaattgtgaaatttgcatttggaatggcgcatcaagttctactttgggcgattctacatatttcacaatggcttcaaataatggcgtcatatcttccgctaaatcttcgtgttcaagacctgcaacaccatttagcgctgaagcatagataattgggaagtctaattgttcatcgcttgcaccaagattgacaaataagtcaaatacttgatccacaacccagtctggacgcgcaccagggcgatcaactttattaattacgacaataggttttaaaccatgagcgaatgctttttgtgtcacgaaacgcgtttgtggcattgggccatcaaacgcatcaacaactaatagaacagaatccaccatagaaagtacacgttcaacttcgccaccgaagtctgcgtgccctggagtatctacgatgttaatgcggtagtcattccagttaatcgcggtattttttgcaagaatggtaatgccacgttctttttcaagatcgtttgagtccataactcgttcatccacatcaccacgagcagattcaaaagtaccagattgttgaagaagtttatctacaagagtggttttaccatggtctacgtgcgcaataatggcgatgttacggagttttttaatatcaatttcgtttttcattatctaatgcttcgagtagggtgcaattttgcacggtatatgattttataaaaaaggtgcaatttacagcacctaattataggttgttgtcttatgttgaagaaaacgagacattatacctcagatttatttacgtagtctcattttctttgctttcaaagcgtgttttatatcattaggtaaacgtaatatatcccagatcaaccgaaaaatcagattttggtaaattcttggtttggaatatataccaatttttttatatacaaacttcggcggaattaaaatatcttgtgtgtaatttttcttttcttcgagaataaaagtaattgggttattcagtggtgataaagggaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctgtttgatgatgaaatgcgtaaggattccctttttcttgataaaaatcaatgcctgtcaaataaagatctttataacccattgcagttgccactgcacacatatagacgcctgatgtaatcctcttattctcatatagttcgtgatattgtaaatgagcatcaaaagctcgtagtttttttaaatagctatgaccaagatcgatttgtggtagtaatttttctaaacgctggattttctttaattctgaatcccctaaatttagaaaagatgataaaataatatcagcatattcatattcattatttttaattaattgcataaacgtatagtattgttcaaaaattacagaacaattaaaaaataccttttttattttcttaccaagaaaataatgatcctcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattggacatattgtaccgttcattgaataaaatataacttatctttaatactaaaaaatagtagctattatacaggctttctgtgctttttactataacgccacaacaaatctaatgaaagtcagatttgattagactataatacttccttaattttttatatagaaagaggatctactatgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaatgtcattgacgtaatcatttttaaaagtgcggtagaatttaccgcacttttcgtttgaaattgtttataacgagactcgggtaaaaatgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataaggtcaaataattaactattagaaataaagctggtatagtttctaaatttattttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcggctgaatttatcttaaaccaagctgatatttataatgaaaaaagtgcggtaagttttaagattatttctggtgaggaacttgagcaacaaggttatcacggaatttggactgtgggtaaaggctctgctaacttgcccgctatgttgcaacttgattttaatccaacacaagatccgaatgcgcccgtgttagcttgtttagttggcaaggggattacctttgacagtggcggctacagcattaaaccaagtgacggaatgagtacaatgcgaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaaggagatatgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaattgatagcaaaaagcacctaaaagttttaggtgcttttaaagttttaatgcttacaaaattagactttcttaaggtttatagatgaactcaattccttcatcatcttcttcagtccaatcgtcatcccaatcttcgtcatcatcaaattgataccccgctagttgttcctgatgataatcttcccatttgaattttacttcttcaggtgcaacttgttgtgtttcagcttcgcgtggatttgctatgataaagtccataatatcacgacaaagtggtggaacatttttccttgttgcagctgaaatcaggtaatagtcttcttcccaacctaattgttcagtgatttctcgaacccgctcttcagcttcttcatcgctcatcgtatcaattttattgaacactaaccaacgtggcttttctgataatttttcactgtattggaaaagttcagattcaataatagcgacattatctgctggattagatccatcaattggagcaatatcgactaaatgaataagcactctacaacgttctaaatgttttaaaaagcgaattcctagcccagcaccatctgcagccccttcaattaatcctggaatatcagcgactacgaaactgtgtgaatcgtctactttcacaacaccgagacttggtactaaagtagtaaatggataatctgcaacttttggtttggctgctgaaacggcacgaataaaagtggatttaccagcattaggtaaaccgagcattcccacatcagcaagtagcattaattccaataataaatcgcgtttttcgcccggcgtacccattgttttttgacgcggtgcacggtttactgatgatttgaaacgagtattccctaaaccgtgataaccacctttggctaccaacattttttgaccatgttgggttaaatcccccaaggtttctttggtgtcgttatcaatagcacgagttcccacgggaacaggtaaaataatatctttaccgcgacgtcctgtacaatctgaactccgtccattctctccacgctctgcggcaaagcgtttattaaagcgataatcgattaaggtattgaggttttcatcggcttgtaaatagacatcgccaccatcgccaccgtcgccaccatcagggccgcctttcggaataaatttctctcgacggaaacttacgcaaccgttaccaccatccccagcctcaattcgaataagggattcatcaataaatttcattaaaacttctccaaaataaaccgcactttaatgatttttatgcggtaataatttatgtccaatcgcggataaaattgccccgcatactacaacaaatgcgccaatatagctaatattattcaattctggtgctgcaaaatctactgggctaaaataatgggcaatatgtgaaaataggatcgtgaaaagaggtacaagtgtgataacaacactgacttttgatacatcccaacgattaagtgcctccgcataagagccgtatccaattaaggtatttaaacagcagtaaataaaacaaatcagagctaaaggtgtgagttcttgcacttgcgagaattcagccatcggcataaagactatggcacaacctaaatacatcattagcaagatttgttgtgaattaaatttacgtaacattaatttttgcgccattccataagcgacccaaataagagcgccccctatacttaaaatgacacctgttgaatactgatttagtccagaaaatacagcaaaacgattattaaagaataaacttagaccaattaacaataagaaaagcccgatcttttggtgcaaccctaatttttctttgaaaatcagtacaccacagatgagcattccaaaagaggataaatgaataaaaatttgtgcaactgacggttcaatgtaattcagcgagctactaaataatagaaaattgccagtaagaccaattactccaataagcataatccacgcatattggcgaactttcattaattcaggtaattgttttttataagcaagtaaagccaataatgaaactgcagcaataatgaaacgataccatacgatagtttgcgcattcattacagacaaaacttgtttcaaggcaataggcaatgacccccaagccatagcggtaataagcgcaaaggtaaagcctaataaaggttgttgtttcattgcttgctcgcttatgtgaaattaaaaagacaaaacgccccacaaaattgtagggcgtttcaatggaatagattttaaattattcagtaacaatacttacgtatttacggcttttctcgccttttacttcaaatttaactttaccatctgcagttgcgaataaggtgtgatctcttcccattcctacgttgttacctgcgtggaatttagtaccacgttggcgaacaataatgctacctgctaatacagattcgccaccgaaacgtttaacaccaaggcgtttagcttcagaatcgcgaccgttacgagttgaaccaccagcttttttagttgccatctacttgatctcctctgaaattatgcttgaatcccagtgattttcacttctgtgaaccactgacgatgaccttgttgtttacggctgtgtttgcgacgacggaatttaacgattttaactttctcgccacgaccttgtgcaattacttcagccactacttttgcgccagcaactactggtgcaccaattttaacatcttcaccattaacgaccatcaacacagaatcgaactcaactgttgcgccagttgcaagttcaagtttttctaaacgaacaacttgaccttcgctcacacggtgttgtttaccgccactttggaaaactgcgtacataaatactccgcttaattgtgttttcctgctttttagcagtccacacttaaaaattcacataaataggtcgcaaattctacggaaaaatcctacctatggcaagaatttatttataataaaataaaaaaattcccttcatttgcggattgatttcagaaagtctgaaaattcgggtaaaatgcaccgcacttttgactgataaatgatgaaaaatgaagaaacaagatcttatgagcatagacgagatccagaaactagcagatccagatatgcaaaaagttaatcaaaatattcttgctcagcttaattcagatgtaccgctaataggacagttaggtttttatattgttcaaggtggtggtaagcggatccgcccgttgatcgcagttctcgcagcacgctctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcccgaaacgagcgaagctaattatatgcgtgtaatttatagcaaaactgcccgtttgtttgaagtggctggtcaggctgcggcaattgttgcgggcggaacagaagctcaagaaaaggcgttacaagattatgggcgttatcttggcactgcatttcagctcgtggatgatgtattggattatagtgcaaatgcgcaagctctaggcaaaaatgtaggcgatgatttagctgaaggaaaaccaacccttcctctgctacacgctatgcgtcatggaaatgctcaacaggcggctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattagtccataatttagcttatatacttgatacccattaattttaattaaactttatgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacgatttatttttacaatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgagagaggtattcgctgcacaatgtgttttgatatgcgctttgaaaaagctgctgaatatgctcatgaacatggtttccctgtatttactagttgcttgggaatttctcgctggaaggatatgaatcaaatcaatggctgtgggcatcgagctgcggaaaaatatgatgatgtagtttattgggattataactggcgcaaggaaggtggttcacagcgtatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaaaaaatagaaaaataaaggtgttgtttcacagaatttgctgaacagcaccttttatttcactattttatcacttcatcttgatcataatgattaatttttaaacgttgaaaataatcttttgtttcttcaatgatcacttttcgcaatccaataagcgcaataagatttgggaaagccatcaaaccatttacaatatcggcgataatccatattaaatttaagtgtaagaatgcccctaaaccaaccaacataatataagctagacgatatagttttacgccacgaataccgacgagataaacaaagcaacgttccccgtagtaacaccaacctaaaatagtcgtgaatgcaaaaaataataaaccaactgttacaatcgttgcaccaattgatgtgcctaaaccttgtgcaaaggcatagtttgtgacggtagcacccgctaattcaggattgttccacgctcccgttaataccaatacaatacctgtcattgtacagacgatgatggtatctaagaatgtacctgtcatggaaattaagccttgtcgcacaggttcacgagtttgtgccgctgcagctgcaattggtgcgcttcctaaaccagattcattggagaaaatgccgcgcgcaacgcctgattgaatcgctttcatcacagtaagccctacggcaccgcctaatgctgcttgcggatcaaaagcactatcaataattaataaaatcgcatctggtactttttctatatttaaaaggataataaccagtgaagtcgtgacgtataaaatcgccataaacggcacaattaccgatgatgcggttgcaatacgttttacaccgccaagaataattaagccgactaaaagcgtcacaataattgcagtaactaaaactggaatattaaaagtatcttgcattgcatgggtaatcgcattgacctgtgggaatgtgccgatcccgaaaaaggccaccatcacaccaaataatgcaaataattttgctagccatttgatacctagtccgcgttcaatgtaatacatcgggccgccagccataaagccatttttatcgcgaacacggtatttaacagcgagtaaacattcagcatattttgttgccattcctaacaaagcaaccagccacatccaaaaaatagcccctggcccacctgcttgtaccgcagttgcaacgcccacaatattacccgttccaattgttgctgctaatgcagtacaaagtgcagcaaaagaggaaacgtctccttttccacctttatcttttttaaataaataacctagcgcacgcggtaagtagcgaatttgaataaagcctaagcgtaacgttaaatagagtcctgtaccagataataatataagtagaggtgcgccccaaataaagctatcaatagctgaaagaattgactcaattgtcattgtgattcctcgtcgtttaaatcaaaaataaacacgacaagaagacgaaaagatacaatggaaaagaaagtgcggtaaaaaaatgaataatttccacacttacaatagattgtcttttgcccctgtccttttgcctgagcgtttgaaaaacgattgaaaaattaaccgctcttttgcgccttcggcgtccatttctaaaatggatctctccaagggttcgtccagtaacagtccctgccatcgcacctgaaagattttacatcgtcggtgtggggtcaattccccgctctccagctaccttcatccgaactcactttccattagatattgaaaagtgtgcgaattctaacaaaacaggaaatgaatttcaaaaaggaatttttatgtagaaaaatcacttcattcaatatctccgcaaaagcgatagccttctccatgtatagtcataatgatatttggagtatttggatgatcttcaaaatgttttctgatacgtcgaattgtgacatctacggtacgatcctgaggttttaactctcgtcccgtcatttttttcagcaattcttcgcgcgtttgcaattttcctggattttcacagaaatgtaacattgcacgaaattcactgcgaggaagtttgaattcttgtccttctggtgtaattaaactgtggctatttaggtctaatttccaaccattaaaacgatagaattctcgaccaaatgtattttctttttcttgatgcgacattgtgcgatgcaatagattacgtgcgcggatagtcagttctctagggttaaaaggtttggttaaataatcgtcggcaccaatttccagacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcggtgattttttacctgattttcctttttgtgatctaaatcatagttttaggtattcaaatttctttgtgatagaatttcgagcatctatatttttatactcaattctatgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaagttagaattatttacaataagtaaaaactctttttctgttatacatcttgtttaacaaatagctaatcattactatagctgggttttaatttatctttaaacgaaaggaaagcaaaatgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtagtttagttgtagtttcataattttatccttatttttgcccacatttatgtgggcttttttatgcctgaaatttatcgcattttttaccgcactttaagaaattatatttaatcttttctatatttaagcaaacgtttgcgttataatccaactcgcttatttttaaccatttaatgaaaggaaaatacaatgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaatttcgtgcgtaaacaaactatgcgttatggcgaaaattcccatcaaaatgccgccttctatgttgatttaaatgtgaaagaagcgagcgtggctacggctaatcaactgcaaggtaaggcattatcttacaataatattgccgacaccgatgctgcacttgaatgtgtgaaagaatttgatgagccagcttgtgttatcgttaaacacgctaatccgtgtggtgtggctttaggtaaggatattttagatgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgtgtgtattcggccaaaattgcaggtatcaaagcacaggatgaaggcttgaccgtggcaggttgtgtgatggcatctgatgcgttcttcccattccgtgatggcattgatgctgcagcgaaagtgggaattcaatgtgtgatccatccaggtggttcaatgcgcgatcaagaagtcatcgatgcggcggatgaacataatatggtaatggtattgactggaatgcgacattttagacattaatttatctaactatccccctctttacaaaagagggggaattgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggctactagccaagatcataaacgcgtgggcgaaaatgatacggggttaaatacaggcggtatgggcgcgtattcgcctgcaccagtaataacacccgaaattcatagtcgcattatgaaggaagtgatttacccaaccgttaatggcatggcagcggaaggcagtgtttacacgggtttcctatatgcaggattaatgattatgccaaatgggcagccgaaagtgatcgaatttaattgtcgttttggtgatccagaaacgcagccaataatgctacgtctcaaatcagaccttgttgaactctgtcttaaagcatgtgacggcaaattagatgaagtaatatcacaatgggatccacgagcttctttaggtatcgtattggctgcagagggatatccaaaggattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagaacaagcaaaatagttagaaatcttgttgaatttaattagataaaaaatattgtacagggtagaattgtattttcctaggatttaggattttgttagggcaacgtttacgattgctctgacaataaattagaattattattttgttactttatgaggttatatcaacttatgcgacaatttgtcatcgtagtattatattctgcaattcttctttcattagaagttatttatagaaaattatttaatatttctagtattgagagatacactgaaagttatttgtctgtctgtttgtctgtttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcattaaattagacgctatgatgaattaatttcatttaagtaatgaaaatttaggaatgaaattttaattaagtttttatccataaacagttaaactatctgccataaattacataacaggagaacacaatgtttacaagaaatatgactatcgctgattacgatccagtattgtggcaagcgatccaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgcggacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatctaaatccactccctcatgcacatgttgtgacaacaacaacccataaaacgttgggcggtccgcgtggtggtttaattctttcatcttgtggcgatgaagaaatctacaaaaaattacaatcatccgtattccctgcaaatcaaggtggtccattagttcatattattgcggcaaaagcagtttgctttaaagaagcattagagcctcaatataaagaataccaagcaaatgtaatcaaaaatgcgaaagcaatggttgaggtatttaaacaacgtggttatgacgttgtgtcaaatggcactgaaaaccacttgttcttagtaagttttattaaacaaggattaacaggtaaagcagctgatgcggcattaggcaaagcaaatattacagtgaataaaaatgctgtaccaaacgatccgcaaaaaccattcgtcacttctggcatccgtgtaggtacaccatctgtgactcgccgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatgatttattttctttcgttgattatatgtttagcggcgattaatatcgccgcttattttttatgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcatcacaacgagataacaataattttgagcaaattcaacgaattatgaattctcaagtttctcaacaagagcgtttaaaatgggcagatgatgtgattaacaatgattctgaactggcccaaaacttaccgcacttgcagcaaaaggtgctagaattgcaccagttttatttacaacaagcggaaaataaaaatgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacggatggagcattaaatagagattaaccgataggaaaccctatcggttaatttttataagtgcggtgctttttttgaggatttttcctaaaaatgctatgctaaacgtgattttattattctaaaatgtgatttttatgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaacgggtacaggcaagacaatggcttttttaacggctacttttcaccatcttttaactcaccaagatcctaatcttgaatatcctcacccaagaactttgattttagcacctactcgagaattagcggtacagattagtaatgacgcagaatttcttgcaaaagcgagtggattaaagaccgcacttgcctatggtggcgatggttatgataaacaactacaagtgattgagcgtggcgtagatattttgattggtacgacggggcgagtcattgattatgtaaaacaaggcgtaattggtttagatgaaatccaagttgtcgtgctagatgaagcggatcgaatgtttgatcttgggtttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaatagaaccggaacaaaaaacaggtcatcgtattaaagaagaacttttttatccatctaatcaggataaaatggcacttctcttaaccttaatggaagatgaatggcctgagcgctgtattgtgtttgcgaatacaaaacatcgttgtgaagaaatttggggttatttggcggctgatggacatcgtgttggtttactgactggcgatgtagcccagaaaaaacgtttatcgttattaaaacaatttaccgacggtgatttagatattttagtagcaacagatgtggctgctcgtggcttgcatatttctgatgtgacgcatgttttcaattatgatttacctgatgatagggaagattacgttcaccgaattggccgtactggacgagcaggggaaagtggcgtttcgattagttttgcttgcgaagaatatgcgatgaatttaccaggaattgaagaatatattggccattctatcccagtgagccaatatgaaacagaagccttgcttgaactgccgaaaccgtatcggttaaaacgtgcagtaccaccgcaagggcatacaagacatcgttcttatcacacaaaataaggtagcctcattctacaccttgatttgatgatgaaaagtgcggttaattttgactgcattttatattcctattttttatatcctcctttgtttatcattcatcttatgggtttacggattacctacagataagtattgttacgctttttgttttttaacttgccaaaaaataaaaaataaataaaatgaacgtccattcatttttgagcaattattgctccttattttactcaaggatcttatgcgacaagctaaaactgatttagccgaacaaatttttcttgctaccgatcgtttaatggcaaaagaaggtttagatcggctttctatgcataaaatcgcaaaagaggcaaatgtagcagcaggaacgatttacctttatttcaaaaacaaagatgagttgcttgaacaatttgcacatagagtgttttcaatgtttatggcaacacttgaaaaagattttgatgaatctaagccttttttcgaacagtatcgacaaatgtggaaaaatatttggtatttcttacaagaaaatcccaccattctatccaatttaaagcaatatgaatctttgcctaatttcaaggatatttgtaaaaacgttaaaaattgtcgttgggatttattttgtgaccaagccaaaaaagctggcttattagcggaattatctgaagatattctctttttattaagtttgaaaacggcgataaatttagcctctgatgcaaaatttatcgatttcgatcttaagcctgaaattttagaatctgtgattgaacgctcttggcgtgcgattcagaaataattgttgttatttttataacggagctttaaacatgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactttaatgtatgaggaaatccgaatgaaatttaccgatatatttattcgccgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaacctcaattctttacgattgaaggcgtggcagaagtacaagtatttggtgcggctgagtatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgaccttgcttgctttaattcttgccataggtttagttgtagatgatgctattgtggtgctggagaatattgatcgtcatattaaagcgggagaaacgccattccgagcggcgattattggtacgcgtgaaattgccgtgcctgtaatttctatgactatcgcattgatcgcagtttactcaccaatggctttaatgggggggattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaatgcgccatctagcgtaaatgtggattacattcaaaatgcaatgcaaccatatatgaaaaatgtaatggaaacacccgaagtctcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggcgctccagtctctattgtattgaaaactgcgcaagattataaatctttggcaaacaccgcagagaaattcctcagtgcgatgaaagcctctggcaaatttatttatacaaatttagatttgacctatgacacggcgcaaatgacaatttcagtagataaagagaaagctggtacttacggcatcacgatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagccaattaaattcggctgaaatcagtgctgtaccaatgccgggtatatcaagtggtgatgccattgcttggcttcaacaacaggcaaatgataatttgccacaaggatacacttatgatttcaaatccgaagctcgtcaattagtacaagagggtaatgcacttacgacgactttcattcttgctgttgtaattattttcttggtgcttgccattcagtttgaatctatacgtgacccaatggtaattatgatttccgtaccattagccgtaagtggtgcattggtgagcttaaatattttatccttctttagcatcgcaggaacaacattaaatatctactctcaagttgggttgattactctcgtgggattaatcactaaacacggtatcttaatgtgtgaagtggcaaaagaagaacagctaaactatggtaaaactcgaattgaggcaatcactcacgcggcaaaagtgcgtttgcgtccaattctaatgacaacggcggcaatggtagctggcttaattccattactctatgcaacaggtgcgggagcggtatctcgctttagtattgggatagtgattgtagcgggattatccattggtactattttcaccttgttcgtcttgcctgtggtatatagctatatcgcaactgaacacaaaccattaccggtttttgatgaaaataaaacaacccactaattaaaacatagaaaaaacaaaccgcacttaggttatcttacgtaatttgtacttataaatagttgttttatccaacttttttgagcataacctgtataagtgcggtatttttttattctgttaattatataaataatccacttatgttagtctttatttaaagactatttttcagtaaacttagcgaattttgttgaattattaaaattatcacttcaaatctaggaatttattgtggcacatcgagattttgctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaaaaacggaagatatgaaaaatacagagtcagaaatcgtaaaattggaatcaattaaaaagcaagactcacagaaaattgaaagcgcaaaaaaagtagaacaaataaaaacggttaataatgtacgggatagcaagaaatttggtttacaatgcggtgcttttaaaaatcgagcgcaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagctaaaactgttaccgattgtgttgtgattggtatgtaatatatatttattttaatgctgagtactaaaaggtggttttgcaaaccaaatcacaataagcaatcctaagaatcccatagctgataaccaaaatatttcatttgcgccaataataaatccttgcgatgttatttgttgagcgaggtaagctgaagtttgcgtatcacttaaaccaaattgattcatttgatggtaaaaactttgggaaatcgggttataaggattaatgtgttctgttaattgagtgtggtgaacagcttcacggttataccacataaatgtggtcaaagatgttcctacagaacccgctaaagttctcaaaaagttaaataagctagaggctgaagccattttatgcgcaggcaagccagacagcgttattgtagtaagtggcataaagaaacaggacaccgctaaaccttgcactaattgtggtaaagctacatcaacaaatgtcattgatggctcgaaagttaccgctcgccaataaaatgttattgcatatacaataaagcttatcgtcactaaaattcgcatatcgatcttataaccgaaacgcccaataatcggtgaaagcaaaattgggaataatccaactggggaagccgcaagccctgcccacgtcgcggtgtaatggaagacttgttgtagcaagagcggaattaataccacagaacctagataaatcaaaaaggctaaactagtacataaacaccctacgctaaaattacgagaatggaaaagtgaaatatccactacaggattgtcatctgtcaattcccaaataaccaaggcaatcagacaaacgacagcaacaacggctaatataatgatttcattagaattaaaccaatcttgctcacgaccctgatcaagcattaattgcaaacatcccactcctaagacaagtaaaactaaaccgactttatcaataggttgatgaacaatttcactttctctgcttcccaaaatcttccagctgattagcacaactaacaaaccgatcggaacattgataaaaaagatccatccccaatggatattatcgctaatccatccgcctaaaattgggccaaaaataggcgcaaccacaatagtcattgaccaaaatgccaatgccattccgcgtttttctggtggataattatttaataataaactttgcgaaagagggatcactggacctgcgacagcaccttgaatgacgcgaaaaataattaacgcctcaagactatctgcaatcccacagagccaagaagagacaacaaataaaaaagttgagactaaaaataaccgcacttcgccaaaacgttttgctaaccaacccgttattggaatagaaatcgcatttgctaccccaaaagaagtgattacccacgtaccttgactaaaagatgcgccaagatcgcccgcaatagtaggaatcgccacatttgcaatggtagaatctaatacctgcataaaggtggcgagagataaagccagtgttaataaaatcagcacaccaccttgaataggcgggaatttttttgcggaattgtccataacgccgccttaatggctgttttgctgaatgatagattcaatcaaattttctaccgcactttcatcatatttaagtgtatcagtagaaaataacgttttcggttctgttttttctcgtagcattgcgcctgatgaatctgaaattcttacttttgccgttgcagaaagaccaattctcaatggcgtttctgtaaattgttgtggatctaatttaattcgcacaggtacacgttgtaccactttaatccagttacccgtagcattttgcgaaggtaaaagagaaaacgcattgccagtccccatttcaatgccatttatcacgccatcaaattctttatttttaccgtataaatcaaaatggatttttactggctgaccaatgcgcatattcgttaattgggtttctttgaagttagcttctaaccacatttgttcattagataccaccgccattaacgcgccacccactgaaacggcttgcccaacttgaacattacgacgcgccacatagccatcaattggacttctaatttttgtacgttgcaaatttaaccaagcctgtttaagcgagtttatcgcattctgtatttgcggttgttcacgtaatggaacgttacgcaataaagcctgattagcagccaattgatttttagaggcatttaaatttgctttggcaagctcgacagcttcttttgcgtgttggaaagattctttatcaatcgcacccattttttcaagttgaactcggcgcgccaaattgccttgagcttgagctaaagaaatttcattggcgtgcacagctgattgcaattgctgcacagtgaaacccagttgttctacctgacgtacagcattggcgagattgcttttggcctgttcaaaactaagtttcgcattggtatcatccaattcaactagaatatcacctgcatggactttatccatattgtctgcattaatcttcgctacattacctgcaacttgtgatgataccattacttgatttccacccacataagcatcttctgtttcttcaaaatccttcaagaagaaaaaccaatacaaagcacaagcaataccaataataagcaggagaagaataaaaatgcttaagccttttttacggttagttttatttgatacagatttatttgatggagtttcaattgcagttttcgtcataatgtcttccctgatttgggataatgtttaaaaatgggatatttaaaactatcaaaaataaaatgaaaggtcattatgaaactttaaaaaggggaactcaaggggaaattatcatctctttgtttttgctagattaatgaatgttctagaagtattgtttcatttatttgatttattttcgggtaagaattaaaaatcggcaatcatagcgattttgtgcatctgccttacgatattcatcaaattcaatttcccactcctcccaattcaattgagggaaaaaagtatcgccatctagttctgtttgaatttgagtaaggtataacttatctgctttgggtaaatattgtttgaataactcgcccccaccaatcaacataatttcatcaaaatctctgacaaaattgaccgcactttcaaagctatctttccatatcacaccttcgtgttcaaaaagctggcgagaaagtacgatattggtacgtttaggtagtggacgaccaatactttcaaaggttttacgccccataatgacaggtttaccagtggttttctgacgaaaccaagctaaatctgcaggcaagtgccaaggcatttgattatctttaccaatcacattatttaatgttatcgccacaattaaactaaatgtcatagatccccctaaaatttgccgttactatacctgatattaagtgatttttcattgatttagtgataacgttaatgtcaattttaagaacgttggaaaggactatgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtcataatgccctttggttgataaaagcactgatttatgaaacaatcttgagctatttttataggaaaaatgtaaggtaaaacgatagtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtttgttatatgtttctaaacattggttgcgttataaattgccaaagcgtttattgcgttatgatagcaagccgatgtgtattgggcagaaacaacgctggtttttgctacagcttgttggcgatgaaaaaaatatcaatatgaaaacgaccaaatcgccagaatttgatgggtggcgttgggtaagtttttggtatcctgttcgtcaagttgtgtcttttaagcgagatgtttatcgaaaggtaatgaaagagtttgcttcggtattatttacggataatccaccaatattttccgcatctcgtgaagcaaattcacagtctaattcggcaaataaaaaatattctcagacaaaatacacaaaacgccatttttacaaatcaaaaggtcaataatgttcacttttattcttctttgtttacttgttggtgcattagcgggttttcttgcaggattatttggtatcggcggagggttagtaattgtgccaaccttagtgtatttactgcccattgtagatgtaccagaatctttgttgatgtctaccgcacttggcacatcatttgctaccattgtgattactggcattggatcggcacaacgtcatcataaattaggtaacatagtctggcaggcagttcgcattttagctccggttattatgctttctgtctttatttgtggtttatttattggaagacttgatcgtgaaatttctgccaaaatttttgcttgcttagtggtatatttagccacaaaaatggtactttcgattaaaaaagatcaagtgacaacaaaaccacttaccccccttgcttccgtaattggcggtattttgattggtatggcatctagtgctgcgggaattggcggtggtggatttattgtgccgtttttaactgctcgtggcattaatatcaaacaagctatcggttcttccgcattttgtgggatgttattgggcgtatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataaggaaaattatgaattcaaattatttacttcttccccactttgatccgagtatttttacgcttggcgatagtaatatcggcttacgttggtatggtttgatgtaccttttaggttttgtttttgcacgttggcttgcggttcgccgtgctaatcgcccaaatagcggttggacagtagatcaagttgataccttacttttcaatggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcctattcacaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttgcgattctgaatatttttattaaaaagccacgtccaatggcttctgttgcaggtttattcttaattggttatggtgtcttccgttttattgtggaatatgtgcgtgaacctgaagttgaaaatttctttgggattattacacgagggcaagccctttgcttaccaatgattattggtggtgctttcattatggcttgggcttattcacgcaaaagtgcggtcataaaataggagatttttatgaagcaatatcttgatctttgtcgccgcattgttagtgaaggggagtgggttgctaatgaacgtacaggtaagcattgcctcacggtcattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgtaaatgcagcttggcttgcaaatccgcatcgtagaggcgttgatgatatggggcgcgtatatggtgtgcaaggcagagcatggcgtaagcctaatggagaaaccatagatcagctacgtaaaattgttaataacttaacgaaaggtattgatgatagaggagagattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaatggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaattctttatttttccttatatttgaaacttaaaatccaggattgatcgttatctcaaaccctgttacttgcggaaattcttcttgaattagtgttaataattcaatttgtttaaatagaatcccctgccgaacaatagcattagacacttcaataaaaattaaatgatctgttatgttgccaatacgaaatttgccgtgaaattcctgtggaaaaatgcggttaaatttttgattaagttcattgatggcaagaccttttttgattattttggcaaagggcgattgctcaagcacatccataatattgactgctttttgataacgatcagccttgttttccataaagtcagcccccagtaaatgacatcagtttagatttccgctacaatacacgcaattttcataataaacaatgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataatttaagttttgcaataaggcgaagcccttaataatcaagcgattaattggcataggggctaaaatttagcccctatatttttatctaaaagtgcggtcaaaataaaccgcattttcgacagaggattttaaaaatggctgaaatcacagcatcattagtaaaagaacttcgtgaccgtactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaacgaagtagctgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaacgcgtaattctttaaagataacgatatgttaataagcccaacttaagttgggcttatttgttttataggataagctgcttaattaacgggcttaaacttttttagttacgtttagtaaaataaaaaatccacactttaatagtaaacttttaaagtgtggattttgtaataaaacctcagaagaaattaagaaattttcttttctaacgcttttaaacgtttatttattccatcaatacctaacgttagtgctgctgttttacgccattctttattcgtttgcaatggaataccagaggaatatacgccaggctctgtaattgggcgcataaccattcccattccagtaatggttactttatcgcaaatttccatatgaccattaatcacacttgcaccaccaattaagcaatagcgaccaacagttaagctacctgccataataacgccacccgcaaccgctgtaccagtgccaatatgaacattatgtgcaatttgacaaaggttatcgataataacgttatcttcaataatcgtggcatctaatgcgcctctatcaatacaggtattcgcaccaatctcaacgttattaccaattattacttgccctacttgtggaattttaatccaacgaccacgatcatttgcataaccaaaaccatcactaccgataactgttcctgattgaattaagcaattagctccaatctcaacgttatggtaaacagtgacattagcccagagctgagtgcctgaacctatcttagtatttttaccaacaaagcaatttgcaccaatgatcacgttatcacctagtacaacaccttcttcaatcactgcgttcgcaccaatagatacattttcgcccaataaaacaccatcaaaaatgaccgcactttttgcgattccttgtgccgcttttggcgtgctatccatatattgcgctaaaattgcgtaagccacataaggatctttaacaataagtagattgctttctggagaacagtgttcaacatcctcttcagagacaaccaaaatccctgctttagaatctttcaataatgcacgaaattttacgttagaaataaaagtgagttgatttgattgggctttatcgagaggcgcgatattctcaacaacaacatcggcgttaccgcgaacggtagcgccgatttgagttgccaattcttgtaaagaataggatttttgcattatgagaacctattattttttctcttgtgctttttcagaagcagggatagattttaatacttcttcagtaatatctttaccctctaccgcaaatacaactgaatttgcatcaagcacataagtataaccttttgcttttgctaaattatttgtcgcagtttgaatgctatctaataatttaccacgttcttcagcttgacgtttttcattttgagcttggaattcttgaacttttttatcttgttcttgcattagtttttgtaattcagcatcttcagccgcacctaatttattaatttcctgttggcgtttttgaatatcagcttgacgtaagcgaggtgcatctttttctaaagccgcaacttttgcttctacttttttacgagcagcagcaattttatcatcaacttcttttttgcttgctgctaatttctcagctacaggtttaaattcagcatcaagtttatctgctactgcttggcgatctgggtgatgttgaaaaatataacctgcattaatgaaagcaattttttcttcagcggaagcatagcctgaagcaagtgcaatacctaaagcaagtgcggttacttttgcgatgtttttcatttgataaatatccttaattaaatgatgggtttaatattttctctgcccaattaaattaggcagagaacgttgtttttgagttctgatgaagaaaaaagttcaatttattagaaagaacctccaatactaaattggaactgttcgacatcatcattttcatattttttaattggtttggcataagagaataccaatggcccaataggagattgccattggaatccgacacctgtagaggcgcgaatacggcttgatttgccataatcgggtaagctttttaatacattgttatctaacccactcttatccgatttccacttagtattccaaacacttgccgcatcaacaaatagggaagttcggaccgtattttggctcttatcgctcacaaacggtgttggtacaataagttctgcactcgcagttgtgattgcattaccaccaatcacatcagaacttatcttattaaaagtaccattactattactattactattaccattttgagcggcataaattgcgttaggtccaatactaccataagcaaaaccacgtaatgaaccgatgccacccgctgtataagtttgatagaacggtaaacgcttgtttccaaaaccatttgcatatcctgcagatgcttttgcagatacaacccagaggtgatctctgtctaatgggtagaaaccctgtacatctgcacttagtttgtagtatttgttatcagaacctggaatagtaactcgtccaccaagacttgctttaacccctttagttgggaaatagcctctattaaggctgttatagttccaaccaaaagaaaaatcaaagtcatttgttttaatgccattacctttaaatttcattgattgaatatataaattacggttatattctagagcaaagttactaattttattataggtatggcctaatcctacataataggagttattttcatttacagggaaacctaaagtaacattacttccataagtcgtacgcttatagttagaggatgtatcacttttagagttatcgtagttttcaaagaaaacatttccaccaagacttacaccatctttagtaaaatagggctcggtataacccaaattgacactcgtaccataatcatttttcgtaccagctatacttactgcagcccctgttcctaagaaattatcttgtttaacacttgcttgataactaataccactctctgtaccgtaaccaataccaaagttgatactacccgtgttacgttctttgactttatatacgacatccacttcatcattgctaccattgataggatcaattcggttttcgactgtttcgaagaaacctgtacgatctaagcgaatttttcctaactcaactaattgtgaattataccaagttccttcttgttggcgcatttcctgacgtaaagtgctatcagcagaaacggtatttccttcaaagcgaagttggcgaacagttaaacgtcgtccagcatcaacaacaagggttatcgctaatgttttatttgcatcatcaaaatcaggtactgaatttaccgttgcgctaccgtaaccgcgttctccaagttttgctttaattgcattttctacatctgcaatatcactacggcggaaagtatcatttaaatgtaatgctgaaagtaaaggttcaagctcggcagacatacctcccagattacctataatgcgtgcactacgaaggtcatactgtaaaccttcatttacatcaatgtgtaacattaacttttgttttttcatcatttagctgaacatccgttttagtaatttgtgctttggcatagccattatttaaataataatcacgaattgactgcaaatctttctcgaattgcgcaccttcaaatttatttccccataatttccaccaagaatcaggttgtaattccatttgttcttgtaatgtactgctactaacagattcgttccccttgaaagttaatgatgccaattttgctttatcatcttcattgatttgaattaaaatttcagcgcgattatttggtagcgtattgacaataggttcaacggttgcgttatagcgacctacacttgcatagtgttcttttacacttttggcaaattcatttaatttttctcgaattaaaacatcgccaactttaaacccgttagcatctaagttttgttttagtgcttcagtgggaataatagagttacctttgattttaacatctgaaatgatcgatttagccacaacgctaacaacaagcacatcgccttcttgatgcgctttcacatcatcgaatcgaccacttacgaataaagagcggacaatattagccacatcattgtcagtcacacgctgaccggcacgaacaggtaaacttgctcggatttgttgttttaagtcaccttgaacaccatccacacgaatatcttttgccacaaaaggtgcggcaaacacagtcgttgtcgtaccgaataataaacttgcgattagaagttttttcatcgattgtatcctatataaattatagacgtaaaaaatcattaaataatgcaaacaccgttaagcttaataacagtgctgcgccaattcgataacagatgctttgcacccgctcagaaacaggttttcctttaacagcttccattgttaaaaaaactaaatgaccgccatctaatactggtaatggaaataaattcataatccctaaatttacactaatcaatgccataaaacttaaaaaatacaccaatccaatatttgctgatgcaccagcaccttttgcaatagaaattggcccacttaaattatttaatgacaaatcgccagtaagtaatttccctaatattttcaaggttaaaagggaaagctgccctgttttttcaatgcctttttgtaaagattcaagaataccatattttaattcagtacggtattcatccgctaattttgtcaaggttgggctaaccccaacaaaccatttgccattttgattacgcactggagttaggactttgtcaaatgtttctccattacgttcaactttaatagaaaaagattcgccttgttcgacctgttttataaaatcttgccaaggaagtgcggttaaattttcttttaaaattttatcaccgatttgtaaaccagctttctcagcgggagaattttgaacaactttagaaagcaccatttcaattttagggcgcataggcataatccctaatgcctcaaaagcactttctttttcaggatcgaatatccaatttgtaagatttaaagtccgttgttgttcaatattagaattgaaaggagaaagggtaatttcaacattaggctcacccatttttgtggcaagtagcatattgatggtttcccaatcttgagtttcttcgccatcaaccgctagaatttgtgtattaggttcaatgtgagcttgtgctgcgatggaacttggtgttattgattgaatcactggtttaaccgttggcattccataaaggtagatgatccaataagcaaaaattgcaaaaataaaattagctaaagggcctgcaataattacaaatgcgcgttgtaatacgcttttactgtcaaatgcttgtgatttttgctcagcaggaactacttcattacgtccatcaagcatttttacatagccgcctaaaggaatcattgaaaccgcaaattctgtaccatatttgtcaatgcgtttccaaattacttttccaaaaccaatggaaaaacgatggacttttataccgcactttctcgctgcccaaaagtgaccatattcgtgaacggatactaatacagcaatcgcaatgataaaagaacctagtgaccacaaaaatgacattaaaaatccttataagacaaagaaatagaaatagctgaaaaaaggtactgcggcagtcaagctatcaatgcgatctaacacaccgccgtgaccaggaatcaattggctactgtctttaactcctgactcacgtttaaacatactttcagttaaatcgcccaatactgaaattgcaactgtcgctacagaaagaatgataaatccagtaatatttcgatcgcctactaaagtattgttagagaaatgaataaagataaaagaaagcactaatgctgtaattaatccaccaatgaccccttcccaacttttacctggcgatactttaggggcaagtttacgtttgccaaaggcgcgtccgctaaaataagcaccagaatcagccgcccaaacaagtataaatacgtaaagtaataaaaataagccgtgataaggatcatgggtatagtgttctaaacgtaaacgtaatacacctgcgacaaatggaatcaacgtagaaaaggcaaataaaagttgtaaaagtggatttttagaccaaaatttagctgatttaggataactgatcacaagcaacaaagctaaaccccaccagctaacagcatttatcaataaaagctgaagatgttgttcaaacacacgccctgcatctaaatagttgccctcagtatagagccataagaagataaatacgcctaaaaaggtagccacaaaaaaacgtatcaaaggttgtttaaggcgagcaaattgagtccattcccaaatgcctaaaatcgctaccgcccctaaagcgagggcaaaataaaaaggcgtgaataaaaatagcgcacataaaactgcagcaattaacacaatagcagataaaactcgttgtttaagcataattttaatccgtttaactattcagtcccgccaaaacggcgatgacgttgttgataacttgcaatcgcgtgattaaattctaattgattaaaatcaggccaaagcacatcggaaaaatataattccgcataggcaatttgccataataaaaagttgcttatgcgctgttctccactggtgcgaattaataaatccacaggtggtgcattttgggttgcaagatgatgttgaaaagtcgagttattaatatctgaaactgacatttcttcttttttaactttttctgcaatttgtttagcggcttgaataatatcccaacaaccgccgtaatttgccgcaatattgagtgtaagtgcggtatttttttctgttaaattttccgcttttttgattttttcttgtaaagtttcactaaaacgagatacatcgcctataattttcagacaaatattatttttatgtaattttttcacttcgcgatccaaggcttgcataaaaagcgacattaacgcgctgatttcttgttctgggcgactccaattttcgctactaaaggcataaagtgtgagtacttccacaccgatttgtcgtgcataagccactgctttgcgtaccgcagtaacgccattggcgtgtccgaaaattcgcattttatttttctgttttgcccaacggccattaccatccataataatggcaacgtgttttggtatatttgtttgatccaactctatcattatttttattattgagagacctctataaatttggtggtaaactatatcataagttatattggcttgccatggattcctttgttctaatctgttctgtaaaaattgaaaatttattgtaaaaaacaactaaaaaaccaccgcactttttatttctctccctattaatttttgccattttacggtattctatgccacattttctattgtcaaaatgctgcaaaagtgcggttaaaatttaaggtgattttatgcaagaacaatatcgccccgatatgatcgaaccaaaggttcaacaatattgggcagaaaataaagttttcaaagcaatcaaagacgaatctaaagaaaaatattactgtctttctatgttcccatatccttctggtcgcctgcatatggggcacgtgcgtaactacactattggtgatgtcatttctcgttatcaacgcatgctaggcaaaaacgtattgcaaccatttggttgggatgctttcggcttacctgcggaaggggcagcaattaaaaataaaaccgcaccagcaaaatggacttacgaaaatatcgcctacatgaagaaacaacttcaacttttaggctttggttttgactgggatcgtgaaatcgcaacctgtaaaccagaatactacaaatgggaacaatggttcttcactgagctttacaaaaaaggcttagtgtacaaaaaaacctcaaccgtaaactggtgtccgaatgatgaaacagtactcgcaaacgagcaagtacacgaaggttgttgctggcgttgtgatacaccagtggaacaaaaagaaatcccacaatggtttatcaaaattactgactatgccgagcaattattaggtggtttagatgcccttccacaatggcctgacatggtaaaaaccatgcaacgtaactggattggtcgctctgaaggggtagaaattacctttgatgttgcaaataccaacgaaaaagtagcagtttacaccacgcgtccagataccttttacggcgtgagttatttaggcattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggcttatttgctattcatccattgacgggcgaaaaattaccgatttgggtcgctaatttcgtgttaatgcactacggtactggcgcagtaatggcagttcctgctcacgaccaacgtgactttgaatttgctcaaaaatacagtttacaaatcaagcaagttattgaacccattgcagatgaagaaattgatttaactaaacaagctttcgttgagcacggtaaattagtgaactcagctgaatttgatggtaaagactttgatggtgcattcaacggtatcgcggataaattagaaaaattaggtgttggaaaacgtcaagttaattaccgtttacgtgactggggcgtttctcgccaacgttattggggtgcgccaattccgatgctaacccttgaaaatggcgatgtagtacctgcaccaatggaagatttacctattattctgcctgaagatgtggtaatggatggcgtaaaaaacccaattaaagcagatcctaactgggcaaaaacaacccttaacggcgcaccagcgttaaaagaaacggatacctttgatacctttatggaatcctcttggtattacgcgcgctacacttgtccacaatatcaaaatggcatgcttgatgcggaagaagcaaactattggttaccagtggatcaatatatcggtggtattgaacacgcaacaatgcacttactctacttccgcttcttccacaaattattgcgtgatgcaggatttgtaaccagtgacgaaccagccgataaattattatgtcaaggtatggtgcttgcagatgccttctactacacaagtccaaccaatgagcgtatttgggtaagtccaacactggtgactcttgaacgtgatgaaaaaggcagaattattaaagccaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatctggcgtagaaggggcgaaacgtttcttagggcgtgtttggaatttggtatatcaatatcaacaaaatccagcaaaaactagcctagatatcaccgcactttccgcagaacaaaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcggcagatgcagatgaagacacagtcaaaacgattgcttttgcggatgaaaatgtgaagaaatttattgataatcaacacattgtcaaagtgatttatgtcgtaggtaaattattaaacgtggtagtgaaaccataatacatagggtgtgtggatttaaaattcacgcaccattttttataggtatgtgaaatatttacattttacacgtcctacaataaaggtaatttttatgatcaactcaatcaagactttactgcttatcgcaacattagcaattctttctgcttgcggttggcattttcagcagtcggttactatgccaaatgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataatgaaccgcatttttccagagcaactaaatcatcatcttgcgcaaagcttggctagagtttatctcttgcaagggcaagatcctttattacttagtgaaactgaggatacactttgtcaagtggcaaaccagcaaggttttgatgaaaaaaatactattcaggttgatagccaaactgattgggcgcaacttatagaatcttgtcaatctatagggttgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaatgaagcaattcagcaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtagtcacaaggcaaataaaatagacaatattgaaataagatttttgataaaaaagaaattttttgctggaaaaatggtcccccctaccggacttgaaccagtgaccaagcgattatgagtcgcctgctctaaccgactgagctaaggggggagagtgcggtaattatagagaaataatcacttgaagtctataaaagaagggatgattgacgaaaaatcaaccatccctttttacattattgaagcactgaaatatcagctacttgtaagaataacccttgtaacgtatttaaaatcgctaatcggttttggcgtagtgctggatcttcagcatttaccatcacgttatcaaagaaactgtctactggcgcacgtaagtttgctaatttatccaatactgcggtgtaatcgccttgtgcgataagcggttgtacttcagtgcgtaatgccagtaccgcttcagcaagggctttttctgctggctctacgcaagcggttaaattgatctcgccaattgccgcacctgctttcgctaagatgttgctaacacgtttatttgctgctgctaacgcttccgctgaatctaaagtacggaagtgtgaaaccgcacgcacgcgcgcatcaaaatcagcagggcgagttggacgacgtgccaataccgcttgaattacatccaccgcaatgccttcatcttgataccatgcacggaaacgaccgagcatgaagtctactacctcatcaaggattttttgttttggaactaaatcatcaccacgtgtaaagaatgaaacataaccttctgggtattcactaaatccacctcttgttttggcaataggtgcattacgtagtctttcgttatcaagttctttatataaatcaaatgctttgctaataatgtcattcagatcaagaggcaaatttttctcaacgataatacgtaatgcacctaatgccgcacgacgtaatgcaaatgggtctgcgctaccttttggtgcttggccgatgccgaagatacccgttaaggtgtcaaatttatccgctaaagcgaccgcacttgccactaaagacttaggtaattcatcacccgcaaagcgtggcatatattgttcgtttaacgccactgccacttcttcatcttcaccgtcgtgacgagcataatgcatacccattacgccttgcgtatcagtgaattcgaataccatgttggtcatcaaatcacattttgacagtaaacccgcacgttttgctttcgcttcatctgcgccgatttgttttgcaatttcgcctgcaagttgttcaatgcggtcagttttgtctttcaatgtgccaagttgttgttggaacaacacggtttctaaacgtggtaaacgatcaaccagtttttgttttaagtcggttttgaagaagaattccgcatcggttaaacgtggacgaaccactttttcgttcccttcgataatcgcggttggatcttctgggttgatgttcgagacaaagataaagtgcggtaataatctgccgtctttatcataaatcgggaaatatttttggtctcctttcatggtgtaaaccaaggcttccgcaggcaccgctaagaagcgttcttcaaattttgccgctaaaacatttggatattccaccaaggaagtgacttcttcaagcaggctttcttcaatgtcagccacgccaccaagtgcggtcgcttttgcttgagattttgccaaaatttctgctttacgctcattgaaatctgccaccacagaacctttatcacgcaataattgcggatattggtctgcatgttgaatgtcaaattctttctcgcctaagaagcggtgaccgcgaatggtgcgagcacttgccacacctaaaatttcgccttcgattaactcatcacctaacaacatagtcacagtgtgaactgggcggataaattgcacggttttatctgcccaacgcattggttttggaattggcaatttcgctaacgcatttgccacaatatcgttaagtaagtttttggtcggctgacctttaatttttgtacggtgaacgagccattcgcctttatcagttgcaatgcgttctgcttgctcaacagtaatgccacaaccacgcgcccagccttctgccgctttagttggtttaccttccgcatcaaaggcggctgatactgcaggccctcgtttttcgatttctttgctcggttgttgggttgctaagttcaacacttttacggctaaacgacgcggtgccgcaaaccattcgattttatcgaatgataaacctgcttgattcaattccgcctcaacgttatccgcaaaagaggtcgctaatgttttgagagcttttggtggcagctcttctgtgccgatttctacaaggaagttttgggttgtcattttgttttctctggtaaggtgcaacttgctgcattgattacttatttacattttatctatcacatcattaatattttcaataatatattcatgattttctaaaatccaaagaagagatttaattcttgtctgattatcatacttattagttgtgaatttaccataaaagttaccttcattatcaacaatcactggcccacttgtagaatacttattccaaggactttcactgttatacttagagccataagttccgtatttattccaaatactatcgctattatatttagagccgaattcaccatatttattccaaattgatgagttatcatgtttactacagttcaaacagcctaaaaatttatcatgattatctccaccaaaaagcaaatatgctggtgctgcaaaggtatttattgataaaaataataatgggggtaacaaaaatttctgtaatgtcatagcattttccttagattaatataattgattcaatgtggagtgagaattttaatagctcacacacgatttaattgttttcttcgtttaacttctgccacaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataggcttccgccacgcctttggttaaggcacgaatgcgtaaaatatagcgctggcgttcggtgaccgaaattgctttacgcgcatctaataagttaaagctgtgtgctgctttcaaaatacgttcataagctggcaatggtaacggtttttctaaggctaataactcttgtgcttctttttcgtattgatcgaagcagtagaataagaaatcggtgtttgcgtgttcaaagttataggttgattgctcaacttcattttgatggaaaacatcgccataagtggttttgcctaatggaccgtcagaccaaactaagtcatacacagaatctacgccttgaatgtacatcgctaaacgctctaaaccgtaagtcacttcacctgttacgggtttacattctaagccacccacttgttggaaataggtaaactgggttacttccataccgtttagccatacttcccaacccaagccccatgcacctaatgttgggttttcccagttatcttccacgaaacggatgtcgttttgtgttggatcgaaaccgagcatttcaagcgagcctaaataaagttcttgaatattatctggagaaggtttgatcactacttggaattgatagtagtgttgtaaacggtttgggttttcaccgtagcgaccgtccgttgggcggcgtgaaggttgaacataagcaaatgccattggctctgggcctaatgcgcgcaatgcggtcattgggtgagaagtacctgcgcccacttccatatcaaaaggttgcacaatggtgcagccttggtttgcccaatattcttgcagggctaaaatcataccttggaatgtttttacgttaaattttgtactcataatcgttgatctaatgtgattaaaaatgttggtattatacttgaatccgtaaaagggataaaggcgaaaaatgcggttgaaaatcaggctttataaagatatcaagtaagtaatttggaatatttaggtagattttaagtttttttaattatagttttttttgattaatttaatagatttcgattgtttaaacctttctatatgatacgcaagaaattcatttcaacctaactaaatttattaacttcacaaggagtctacaatgagttctcaatgtcctttctcgcacttagctgcaacaaacttaacaatgggtaacggtgcacccgttgctgataaccaaaacagcttaacagctggtccgcgtggtccattacttgcacaagatttatggcttaatgaaaaattagctgatttcgtacgtgaagtgatcccagagcgtcgtatgcacgctaaaggttctggtgcatttggtacttttactgtcacacacgatattactaaatatactcgtgcaaaaatttttagtgaagtgggtaaaaaaacggaaatgttcgcacgttttactaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccatacacaacaaggcatcaaaaacttaactgatgcagaagcggctgcagtcatcgcaagtgatcgtgaaagccatcaacgtgatttatatgaagcgattgaacgtggtgatttccctaaatggacattatttgtacaaattatgccagaagcagatgcggaaaaagtgccttaccacccgttcgacctaaccaaagtgtggccgaaaaaagattatccgttaattgaagtcggcgagtttgaattaaaccgtaacccagaaaacttcttcgctgatgtagaacaatctgcatttgcaccaagtaacttggttccgggtattggcgcaagccctgacagaatgttacaagctcgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagatcaaaaacaatcattattcaacaacacggcagcagcaatgggcgatgcgcctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataatctttcgagttaattattttaaataaataatagtagtaatgaatctgcacccaaaagttaggctaaggtttaactgattagggtgcagatttttttcaatgaaatattactaattcattacataatacttgaacgattttgtaatcgttcaaaaatttgaatgtaaaaataacctataatagcttccattttttatggtaaatattgtatttaagtaatgctaaatatatatcatggcacaaaataatgaggtataaaatggctatcattccccgtcactgcagtaaaatcttcgcgtaatcccataccgcaagccacatcccccacaacccaagagccgataattggatacattccatcaaaacttggcaattcaaatttttgttgataaacataacctgaattagcataaaacgttgagtgttcgcttcctttcgctgcaaattctacaccattatttttctcataatagaaaacattggcaccttctcgacctaacaatggttttttcacccacatcaataaatcttttggtaattcaaaaggcgtaaaataagcaggcaataaattcggatgattaggataacgcgcccaaagttttgccaatagtgctttattacttaacaacattttccacgctggttcaataaatcgtgtttcagccgttgtaatatggcgagcaaactcagcgtggcttagccattctagcggatacaatttaaataacatttcaataggttgatcatttaaatctacaaatttttttgtttcgctgttatagccaatatcttccaccgctaattgatgaatattccaacctgcgttataagccacatcagctaaataatccacattgccccaatcttcacggccagcatcctgcatggcactcaaatggaaatctgttttgccactttgttgtttcaaaaattggaaatgttttattaattcttcatgaatccagttaaattgatcacgatgtttcaagccctcaatttgctccaaccactgccattggacaatcgctgcctccaacaaagatgttggtgtatcggcgttatattcaaacatttttaggttgttgccatcatagccaaaatcaaagcgtccatataaataaggatcttgattacgccaagaggtttcaacaagctgtttttgcaactccgtaaaatgataattttcataatcgccttttttaatttcatccgccgcaaaatctaaacatattgaatgcaattcattagttgtatcctcaatgcgatcaatttccgctaaggtaaattcataggcaacattatcagaccaataatgagatccatcactggaaggcaagttataataatcaaatccaacattaagtagctgttgcaccatatttggtcgagtaggaaacccagttacacgtttcatttagcccccactgctacgatgagtattatttgggctactaaaaccaccacgagatacaggtttgctattcatgcttcctgcatttcctttcacgagcattggttttccaacagaacgattcgtttgaggttgcacaacttgccctgttggtgtggtgacagctcgatttccaggatgatagcttgggccaaggaaactactaattgcacgagccgccatataccctataacgccaccagcaattgcggctcctaaagaaggatcggtactttcagcttttgcagttgattcagcattgttctcgctttgattagcttgtacattattttcagctggattttttaccgcactttctgcattaccattatcacgaatatttaaaccaagcccctgctgtggtgtagtttcagttttctgagtactttcagtatttttatctgcctcacaaagctcaatttttttccaatccgctaaacaatcgtctaaagactgatacacatcacgttgtacttgctcttctgaacagcctcctaataaggccacaatagataaactaactaaaatctgatttttctttttcattgttctcaatttttatcgaatggttttcacgcctagccattgctcagcctgtttattagtaatttcttcacgagtccacatactcattaaatctggttgtggatatttattgctgttatagccgactaaacgggcaaaatcaaatacagcatgaggatagccattaataagcaacaaggctaaataaccactctcatcccaacaaatttcaagtttgcgtgcttcatgatgattagaggttgaatcaacattatacacgtgcaacatatccactatcggttgagcattttgacgcatatcgagcgcataaaaatagccagtttcgccgtcatcttcaaacattacggcaaaatgctcaaatactgtcgaatgtgttcccacttgctttggcgttcctaaaaagagttcgtcctctaaagttaaatgtaacattctctttcctttaaatattagatataaaaacaccgcacttttatacaaagtgcggtgagattttacagtaaattcagcgtgaattacgcttgacctttaaccgcttttaagcctgggaatgctgctggagtaccagcgcgttctaatgcttcttcgatacggattaattggttgtatttcgcaatacggtcagaacggctcatagaaccagttttgatttgacctgctgctgtacccaccgctaaatcagcgatagttgcatcttcagtttcgcctgaacggtgagagattacagcggtgtaacctgcatctttcgccattttaattgctgctaaagtttcagttaaagaaccgatttgattgaatttgattaagatagagtttgcgatacctttttcgataccttcttttaagattttggtgttagttacgaataaatcatcgcccactaattgaacacggtcgcctaacactttagtttggtatgcaaaaccttcccagtcagattcatcttgaccatcttcgatagacacgattgggtattgtttagttaattcttcaagatagtgtgtgaactcttgagaagtgaatgatttaccttcacctttcatttcgtacataccattttctttgttatagaactcagaagatgcgcagtccatcgctaaagtaacgtctttacctaatacataacctgctttttctactgcttctttgatacaggctaaagcgtctgcgttagaggctaagtttggtgcgaaaccaccttcgtcaccaactgcagtgctcatgcctttagattttaatacttttgcaaggttgtggaatacttcagcaccgatacgaagtgcttcacgtaatgttttcgcaccaactggttgaatcatgaattcttggatatcaacgttgttatctgcatgttcgccaccgttaatgatgttcatcattggtaatggcatagaataaacaccagcagtgccatttaattctgcaatgtaagcgtaaagtggtaaacctttagatgctgcagctgcttttgcgtttgctaaagataccgccaagattgcatttgcaccaaagttagatttgttttcggttccgtctaaatcgatcatgatttggtcgatttcagcttggtttgttgcatctttaccaacgatagcttgtgcaatttcgttgttcactgccgccacagcttttaatacgcctttacctaagaaacgagatttgtcgccgtcacgtaattctaatgcttcacgagaaccagttgatgcaccagatggagctgctgctaaaccaacaaaaccaccttcaagatgaacttcagcttcaacagttggattaccgcgtgagtcgatgatttcgcgaccaatcactttaacgatttttgccatttttattttcctcaattaagttaattaaaacgggttaggcgagcctaaaacaggcgatatgataaagctattttgagattttgtcttgtaaaaaatgcgtatgctttgatctttatctatttattgtcttgagatacttagagcgcaggcataagccgagctccacgcccactggaagttataaccaccgagccagcccgtcacatccaatacttcaccaataaaatataaaccgctgacttggttgctttccattgttttagaagaaattactttagtatccaccccacccattgtgacttcagctgtacgatagccctctgtgccatttggagtaaattcccagtgatgaataaaatccaccagattttttacccgcactttgctgatgttagcgctaacttcatcttgcacaatgccttgttcaatccaaagttcgaccaattttttcggcaataatcgaaccaagatggttttcaacatttgttttggtgaatgttgttttgcttgattaatttcctcttccacattgtggttcggtaataaatcgatttccactgactcagtgggctgccaataattagaaatttgtaacaccgcagggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagataatgagctggcgtaacctctaaattggtgaaattacaaaacccaccgcccgacatcaaaatcttacgtccgatttttttgccgttgtcgaaaactgttaccgacttgcctagcttagccaattgtgcggcacaaaataatcctgccgcacccgcaccaataataatattttcagaatattggctcacggattttgtcctttttcaccacgttgtaaaaaatccaacatcttcattcgttgaataactgaacgacgatccactgccgcattacctgaatctaataactgctgtaaatacataccggcttgttgatattggcgattttctaaggcaattgtcgccaacaaagaaagactagatacttcatttttatcttttgccaaagcttcattcaaaagttgctcgacttttggggtcacttgctgacctgcttgataataaagtgcggtggctgccaagcctaaaatattaggtttacttcccgacaatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctagaattaaaagggcgactggcaataaccataacaacgccgtattccatttgaatggcggtttgtaattcacaaaatcaccaaatctagccgtcattttatcgataatttgctgattgcttttgccctcatccaccattttgtacacttcaagacgcaagtcataagcaattggagaattagattccaccaaattttggttttgacattgtgggcagcgtaaagattttgccaactctacggcacgagtacgatcatcttgattttggaattgataggtatccaccatttccgcttgagtaaacaaggaaaatgcgaataaaagtgcggttgcaaaaacaaatgttttttgaactcgagtaaaaatatctaataggcttttcatttattcttcaatgcttcaatttttggcaaaaataccgtttgccaagtttctttatccaataaaccagaatggcgataacgaatcacaccattttcatccacaagataagtttctggcgcaccatccacgcctaatttgagggcaagttctccctgactatcatcaatagttaagatgaacggattgcccattctcttaagtatttcaataccattttgcggattgtcgcgataatctacacccacaataggcaacgtttttgcaatctcaattaacaacggatgttcttctttgcaataaccacaccaactgccccacacatttaataaaaatggctgtttaggaaaatctttcgggcttacgatttgtgatggatcatgtaaattagcctgataaaactctggaacgggtttatcaattaaagccgacgcaatttttttcggatcttgatttaacccagcaattaataatacacacacgcctaaaagcacaaagagcggtgcaaaaaagagaagttttttgttcattatttttcctgttttctgcgtaatccgaagacgctaaaaagtgcgccaaaggccattaaaataccgcccgcccaaagccaacgaatcagtggtttataatgtaagcggaaagtaaattcccctttgccgagagaatcgcccatcacaatatataaatcgccccaaaaaccgccattaagccccacttcactcattgtcattgtacgaacatcgtaataacggcgttcggggataatttctgcataaggtttaccattttcagttacgtcaaaaaaggcgacttctgccgtaaagtttggtccgatttcattagaaaattggcgatagtgaaattcatattgtcccagcgtttgactttgttgcggtgctaaacgcacaccaatttcactgccaaaataaccactcattaccgcaccaatagttacaatcgccacgccacaatgcgctaaaatcataccaaattgagacaaacgaatttgtcgccaattttgccataaagtgaccaacaaaagccaaatcgcaagagttaataacacaaaagcgaaagcgtgaaaattcaacgcagaattatggcgtagctgttgccaaatcattaggcctgcaagaattaaagacggaataagcaaccacccacaacgtatcaataatgtgcgatcaaattgccccttacgtatgctaagcacaattaccattaggattaaaatcgccgtaataatggggaagaaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaggcgtgcacagaagtgagcgcgccagaacgaacaataaacgtgcctaatacgctaaaggcaaaagcaagcagagaaaaaagcgttgtccaataactaaatacgccttgtttttccgtcgccattaaactgtgtaataacgctaacccaagcaaccaaggcattaaagacgcattttctacgggatcccagaaccaccaaccgccccagccaagttcgtaatatgcccaccaagcaccaagcacaatgccaatggttaaaaacaaccaagaaaccaacacccatccacgcattgagcgggcaatttgtcgtgcagattggttataaatcaacgcactcaaactcattgcaaaatttaccgcaaagcccacatagccaacatataataaaggcggatggaaaattaatcccacatcttgcaacattggattgagatcgcgcccttctgcgggagcagggaaaatgcgtccaaatggattggaataaaataaaataaacaccgcaaaaccaaagcaaatcaatcccaataaagataaagattgagcggaaaaagtgcggtcattttttcgattaaaaaaagcaaaagcagcaagccataaactcaatgaaaataaccaaaacaacattgaaccttcatgtcctccccaagtggcagccactttaaaaaatgtaggtaattgagagttggaatgtgccgctacatattcaagggtgaaatcatccaccgcaaaagaataagtaagcaaaccaattgagaacgtcgtcgcaagggtaaaaatataactaagcggccaagcagcattaattaaagtcgaattttttttgaacaacccaaattgaggcactaacgcaagaaaaaacgcgctagctgttgcgagtaaaagaaggaaaaagccaagttctggaagcataatgtcgtcgtttttttcgttgatgcgcagataaagtcgctaatcaagtatgtttcattaataaaattaaaaatagcaccttgataggtgctattgtgcttataaaaattaatgattaaattcagcacctaaacaagggcgaattttatttaacatttctttaattacgcgtgatggtgcagcaatgatattgccactgcgtaagtagccgttaccagcatcaaaatcgcaaactaaaccacctgcttcacgcacgattaaatcgccagcagcacaatcccatgcttttaagcccatttcaaaataaccatcaatacggtttgacgccacatagcataaatctaatgcggcagaacccgtacgacggaaatcagcggcatcttcaattaaggcattcatcattgcaaattgagctggcattaattttggttgtttgaatggaaaaccagtggctaaaattgaaccttgaagttcacgtttactatctacacgtaaacgtacttcatttaattttgcaccttcgccacgcacagcagtaaataattcattgcggattggatcgtaaacaaccccgacttcagtgcgattttttacacgaactgcgatagacacagaaaagtggggaagccctgtcataaaattacgagtaccatctagcggatcaataatccattgtacatcgctatctttgccttctttgccttcaattgcgcctgtttcttccgtaataattgtgtgatcaggataagatttacgaataatttcaatgatttctgcttctgccgctttatcaacgtttgttacataatcattaatacctttttgtgtgctttcgatagcatcacggcgttcataatttttagcaatcacattacccgcttttcgtgccgcacgaatagcgatatttaacattggattcatatttccaccagattttaaagaacagaaaaattccgcaccattatagcgagatttgccaaaataaccagttgaaaatcataaaacaatggtttttatagattttcagaaaaactttgcgatatagatcgcaaaaatcacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaatgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaaaatggcgttgttttttctaggttaaatcatcaaaaggtcgccattgtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaattatgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaagaggggatttcagccagagaaatgatgcaaattatcgcaaatacaaaacctaattcaaaagttctcgtcaccattctacgattaggcaaaatcttacaaattccagttgttattgaagaatttccagtaaattaaaaatagcggtctattttgaccgctgttttcattatatttaatactttcttttcaatttgaaaatttatttgttctaaccccttttctgacatttcgggcaaaagaaactattacgctgtccaataattaaactttcaatttttccaccgcactttggacaaggtttatctttattgccatataccaataattcttgtgcaaaataacctgggcgaccatcgggctgtaaaaaatctttaagtgttgttccaccttgaataatggcttttctcaaaacatctttaatcgtgttcactaaagagaaacattgattgcgcgtcaaatttttagcgagtttaaggggatgaatgccacaaataaacaaactttcattcgcataaatatttccaacgcccactaccacagcgttatccatcaagaaagttttaagtgcggtagatttttgacgagattttttgaataaatattctgcattaaattcatcagaaagtggttcagggcctaactttaagaaaagatgaaagtcatctagattctccgtccacaaccaagcaccgaaacggcgaggatcgttatagcgtaataacttgccattattcactacaatatcaatatgatcatgtttatctattgcactatcctgtggcacgattcgaacagatccagacatacctaaatgcccgatgatatagcctttttccgtgtgaataatcaaatattttgctcgacgagtgagatcgacaatttttacattttttagcgttattaattcttctgatacagcccagcgcaatttaggcttgcgcacgacaactttctcaatcgtaaaattcttaagataagggctaataccacgtagtgcagtttcgacttcaggaagttctggcatgattttcaacttagtaagtggatagaataatgatataaagtgcggttagttttaccatttttttatattctttgaaaattaaaatgatgaatatttcaaaaatataggtagttatctaatggataaaatttatatatctcgtttgatctatgctaaaagatttttattttacagaatagccgcctgttttcagatacaagcggttattttttgtgttaattgactaactaattaatcaatgggtggtgtgtaagtgccatttttgatgtcatctttaatgcgatttgcttctgttagtacttgagttaataacgctttaacattttccaatgttgcaatcgggcttagggtagtcattttcagtgattgtttgtcgcctactttagtcacgccaatattcgcttctcctcgagcaaagagttcatctgccacgttttggtttagtgcatcaataaattcagctggatagtcttttggtacgacacggaataacaccgatgcaaactgacttggcacaagcatttctaaggcaggagtatcgttgatgtattgctcgacttctttggtcagttttacgccgtgatcgatcattgaagcgtaaagatcttcgcccaatgcttcaagggtaaaccataattttaatgcgtcgaaacgacgagttgtttgtagcgattttgccactaagtttggcacgccgtgagcttcatcatattccgaattgagataatccgctttgtaattgataaagcgatagttctcaggatctttcaacaagaacgccccacacgagatcgtttggaagaagtgtttgtggaaatcaagcgtgatggaatcagttaattcaataccatctaagaaatagcgataatctttggaaagcaataatgcgccaccccaagcggcatcaacgtgtaaccacgcttgatattcatcggcaagtttgcggattgcttttaaatcatcaattgcgccagcatctgttgtgcctgcggtagcgacaatacaggcagtaattttgccatcagctttaagctgtgcaagtgtttgtttaagtgcaataagatccatttgtgcattggcatttgatggcacggtcacgaccgattggaaccccatgcccatcattgccatatttttttgtacagagaaatgtgcgttttctgaacaaatcactttcactttttgcattgcttctgctggaataccatcacgttgtactgaccattcagagccgtcttcgtttttccagtggtttgcaatcgcccaatcgcgtgccaacaatacgcccattaagttagattgagtaccaccagaagtgaacacgcctgatgtgccttcgccatagcctgctttttggcgtagccagttgatcaaatgctcctccataattgaacctgctgggctttgatcccatgaatccattgattggttggtcgcattaatcagtacttccgcaatttggcttgttaccatcgttgggcaatgtaaatgggcaagtgagtgtggatgatgtactttaaggcttggattaaggaaaatttttaccaaatgatcgagtgatttctgtacacccataccctctttcgtcggattaaaaccgcttattaaggctcgcatttgtttgattgaaccgcctgtgtacattttttcatttttcagccaagcagagactgcttgcaccgcattatacatcgctgtttcataatcgttaatggcttcgttatcgttgcaaaacaaagcttgtttgtgttgtttgaggtttgacataattattcctagatatgaattacacccaattttctgtacgtaatgctataactcgctcaaattctcttaaattgttactaaccagaattaacccttcactacgagcatgagcagctatatgaatatcattttcgccaatcaatttcccttgtttagagagttcagctttaatattgccgaaatgagctgcatgctttggttggtaatctaaaatggtgaggcgtgataagaaatcttcaataaccgcaatgtttctttcgggatattcgcttttttcagctccataatagagttcagccacagtaatgctactcacgcacatttttcctgcattttgattaaagcgagaaagaatttccaatggcctacgcttaatcacgtaaatcacaatgttagtatcaagcatatatttcaacactataaagcctcacgctctggttgaaatgcaatttctcgttcattcataaaatcatcgctaactgcttgatcattcaagaaaaaactatcccaagattggttgagaggcgataaaatccgatcactgcccgatacacgaaccgataattttttgatttcttcagaaaagcgaacttcagcgggcaaacgcacagcttgacttcgattagtcataaaaacagaggcttcaatcatagttattccttatgcttaattgtatatagcataagtatatcccagttttatacagttgagtagaaaaaaggtgggatttccctaccattttgaatttacaagcggtcaaaattcgcaaaacatttgcaaaatcagaccgcttttaattaactacgcaccactttcaatgcgtctacaacagattgtttgaagcgtttgatgaactcttcacattcactttggttgatgtttaccgcacaaagcacgcgaaccacgttgccaccgcgtccgccacgttcgagcaagagtttgtttttgaagcaagctttttggattgctgccgctaattcacaatcgcgcgggtaagcccctatcgcatctttcgcttggcgttcgtctacaatatcgatccccatcattaagccacgaccacgtacgttgccgatgcacggatattctttgcttaattcacgtaatgcgttggttaagtattcaccacgctcttgggcattttgtgcgaggttttcatcacgcataattttaagtgaagcgtaacctgtcgccatcgctaattgattgccacgaaatgtacctgtatgtcctgcaggttgccaagcatcaaattctttacgaatagctaatacagctaatggtaagctgccaccaactgcttttgacatcacaataatatcaggctcaatgcctgcgtgttcaaaggcgaacattcttccagaacggcagaaacccgcttgcacttcatcgacgatcattaaaatgccgtgtttttgggttacttcacgtactttttgtaagaagcttattggtgctggaacaacgccgccttctccttggattgcttctaaaattactgcagctggttttactacgccactttctacatcttcgatgaagttctcaaagtaatgttcaactgctttcgcgcctgcttcgccaccaatgccaaatgggcagcggtattcgtgtggatatggcataaattgtacgccaggcattaaattttcaacggcattttttgcaccaagattacccgttaaggctaatgccccttgggtcataccgtgaaaaccgccagagaaagcaatgatattgccacgccctgtgtaagttttggctaatttgatggctgcttcatttgcatctgcaccagaagggcctgtgaattgtaagatatatttatctttcgggaagaatgacaataattcttcactaaacgcatctttaagtggagtggttaaatctaaagtgtgtaacggcaatccgctatctaatacgtctttaatggcttgcattaatataggatgattatgtcctaatgcaagggttcctgcgcctgctaaaaagtctaggtattcattaccttcaacatcagtaacccaacagccttgtgcttttgcataggcaaaaggtaatttgcgaggataactacgtacgttggattccattacatcttggcgatctaaaaaatgttggtttgaagcaagaattgcttgtacaggggtaatcattgtcatttttgattaaaaccttctaaaagaggtgaaaaaaataagtcgggtgccttgcgataaatttactgtttataaaacagacacatagggcatttgactcgctacttattaaaaaaagcgtttcagcttttttgtttttaccctagtttgcccattggacgggctaggttggaaacaggttttgatgtagggttacgtcaaaacggggacaattgtatattctttttgcaatatgaaaagcaaatttagcttcttacgagtcaaacggctaaataaaaagcaaacgtttctaataagaacaaataaaaaacccgagtttctactcgggtttaaaataattaaatcaatattatttgatttttgcttctttatagataacgtgtttacgcactactggatcaaattttttgatttccattttttcaggcatattacgtttgtttttatcagttgtgtagaagtgacctgtctctgcagtagaaactaaacggattttctcacgagcacctttagctgccattttttagctccttagattttttcgccacgagcacggatttcagctaatactgcatcaatgccttttttatcaataatacgcatacctttcgcagttaaacgtaaggttacgaaacggttttcactttcaacccagaaacggtgagtgtgaaggtttggaagaaaacgacgacgtgtcgcattcattgcgtgtgagcggttattacccacagctggacgcttgcctgttacttgacaaactctagacataataatctccaataattaaatataagctcgagcttacggttcggattgtttaaagctggttaaacctagcttgctacctcgtcaggtcgcgctaatccgacccgcttactatattaaaggtcgcaaattatactgactttgttttcatttctcaagtgtaaatgcgattttcctgaatgtaatcggtaaaaaaatggtcaatattataaaaatttataataaacaattctccgcgaaagaataacaatcgcttttccctacaattaaatgatcaagcacgcgaatttccattagttcagccgcatcttgaatttttttagtaataagttgatccgaataactcggctccgttatacctgaaggatgattatgtgccaaaattaaagctgccgcattacaatagagtgcttctttaataatttctcgcggataaaccgctgatacattaattgtacctaaaaataaccgctcttttttaatcaaacgatgttgattatctaaaaataaaaccataaatacttctctttcctcgtgttgcaattcagtgagtaaaaaaagttttaccgtttcaagatcattaataatcggcgtacttaacatctcttgctttaaataacgcttggtcatttccgtaatcgcttgcagttgaataaattgcgtaatacctaagccttttacagaacagaaagcttttttatctgcggaaagtaaagcgtgcaaggagccaaaatgcgttaatacatttttagaaagtgacataacaggacaatctttgataccagtacgtaaaaaaatcgcaagtagttcataatcacttaatgcttttgctccgaatgccagcaatttttcccgtggcattaattcatcattgttttccatatatttataaaagaaaaataagaaagattttgaccgcactttttaggtttgacgagcaagtgattcaaaatctgcgatgcatatcgtaaaaatagcgttgggcattcaataaaattaaagtaaaataacgaaattgtggttaagtactaacaagggaagaaaatgaatttaaacggaaaacgtgttgtcgtcggtattacgggcggcattgcagcctataaaacaatagagttgattcgtttattacgcaaagcagaagctgaagtacgtgtagtattaaccccagctgcagcagaatttgttactcctttgacacttcaagccatttctggcaatgctgtatcgcaatctttacttgatccacaagcagagctggcaatggggcatattgaacttgccaaatgggctgatgccattattattgcgccagctagtgcagactttattgcccgtcttactgtaggcatggcgaatgatttactttcaacaatttgtcttgcaactgatgcgccaatttttcttgtgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtcgccattacagcaggcccaacgcgtgaggcaatcgatcccgttcgttatatttctaaccatagttcagggaaaatgggatttgcgattgctgaagcatttgccaaacgtggggcaaacgtcacactgatttcaggcccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtagctgaagttgcagaacaaaaaatcaaaaaatctggcgatgaaatatctatcaagttaattaaaaatcccgatattatctcagatgtaggacatttaaaaacacatcgtccttttactgttggatttgcagccgaaacccaaaatattgatgattatgcaaaagataaacttgaacgcaaaaatcttgatatgatttgtgccaacgatgtatctggcggacaagtttttaacgcggatgaaaatgccttgcagcttttttggaaaaatggtcataaaaaattatcgctaaaatcaaaagtagaacttgccgctgatttagtcaatgaaatcatcgaacgctatcaaaaaaccttataattccaaccgcacttttacctaaaaatgaatttcaaacggagtattaaatgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataatttatggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattgtaaataatattcaaaacattaattgacaattaatataaaggattttatcattgctccacttcttgcggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgttgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttggcacaatgtaagccaaatccacctacaccacaaaatagatcccataggttataaataggtaattcagatacccattgttgagctgttgcatataatccctccgccactttaggattagtttgaaagaagccttgtggacgaataaaaagcggaatactattgaaattttctggcaaaaattgttgttctgtcagaaaaatttcttgttctccctccaaaatagcagcgtgcagtggttgcaaattaacgctaaccacttctaagtgcggtagtttttctaataattttggtaattctcgacggattaacggcaatttattttctgtacgtaacacaaaacgcaacattaattttcctgttgcgatactttctgtcagtaaaatatatttaagctcgcctttttgtttagcaatgttataaggtactaaacctgcgcgaccaataaaatctttgaggattgaaaaaattattgagaaacgtgcaggataaagaggacaatcacacaaatcaatcgcactttgtggatcattaggattttttaaaataccaagtattgggcgttccacactaccactaacaagcattttagctttattacgaaagcattgttcattagattgaaaaggagctaaccattgagctttatcgcaattaatagaaatcagttgctgttttaaatgatgttgtttttcagcaagctgctgactataaggtatttcaagccattgacaagaacgacattcattttgttgatagtatcgacaatcaatcattttttgcggcctgaatatctagccaacggctttgaatatctgcgagatttcgatgattcagtttccaacgttgatctaaaaccaagtcattccattcgattacgctacgcttaaataaattttttaagcgagcttgacgagccataaagtgcggttcattttcagtaagttttagattatctaatacttgaatgacaccttcacgttcattgcacagtaacaaaagatcacaacctgcattcagtgcttttttgctacgctctacaaaattccccattactcccgcgcctttcattcctagatcatcggaaaaaattgtaccttggaaatttaatttcttgcgtaaaatttctttcaaccaatattctgaaccacttgcaggctgactatcacattgtccataaatcacgtgagcaggcataatcgcatcgagtttattttgtgaaatcaactgttggaaaggttggagatcgtaaccaaaaatttcgtcttttgcgcgatcatcataaggtgtttctaaatgggaatcggctaatacatgaccatgaccgggaaaatgtttacccgtagatgccatacctgcttgatgcataccatcaataaaattgatggctaaatttaccgcactttttacatcagatgaaaaactgcgatcaccaatcgctcgacattcatgccccaaatccagcactggtgcaaaactcaagtcaatatccaaagcaatcatttctgctgccatttgccaacctgcttctttagcaaaacttacttgttcagttgctgatagtgtttcttgaaaagcctgcattgaaggcaacattgtaaatccatcacgaaaacgttgaactcgtccaccttcttgatccactgtaattaataaaggcttttttactcgttggcgaacagaacgaattaattcttgaatttgttctctgtcttcaaaatttcgagtaaataaaatcaatcctgcaacaagagggtgcgaaagtaactcaacttcctcttgttccaactcttttccttttaaatcaattaacaaggtgctcataaattattttaaataaaggcggtaatttttactttctacagtaggtttaattaaatcgattgatttctcttcttgtggttttagcgaaaattgagcggaatagctttcttgctgattttcccaaatttgggtaactcctaaatgatcataccaatacaaatggtaacttacattcaaaagttgctgacttttattttttataaccgctgatttttgagtcgtttcaacttgaattaaaggcgaaagagacgacgtaatattcaaaatcggctttgttgaataagttaagttttgctctgaaattgaacaagctgcgagcataaagctcgccaaaattagaaaatattttttcattatttcgctaacattttacctaaaggttctccaccaactaaatgcatatgtaaatggaatacttcttgcccaccatatttattgcaattcacaattaggcgataaccatcttccgcaatgccttcttctttagcgagtttagccgctacgctaaataatcgacctagcgctacttcatcttgctccgtcacatcattcactgtgggaatgactttatttggaataatcaaaatatgtgttttagcttgaggggaaatatcacgaaatgcagtgactaattcatcttgatagacgatatttgccggaatttctttacggataattttactaaaaattgtttcttctgccattgtttgctccctataaaaagtgcggcgaattaacctgtccataattgttgcttatttagtctaacttttaaggacagagcaaatcaatcgcactttttgttttacaatgaatttaattatgcaaagtatcgaacttctccattgcccactacattttctacacaacgtgcacaaagtgttggatgtcctgggcttaccccaatttcgtcagaataatgccagcaacgagggcatttttctgcgttagaacgtgttacgcttaccgcaataccctctaattcgctgtccgctaaatcagcaggtttttccgataaagattttacatctacttttgaggtaattaatacgaaacgtaattcattacctaattgtgctaacaatgcacgatattcgtcattagcataaacggtcacttctgcttctaaaccgccgcctatttctttattgttacgagaaatttctaatacacggtttacttctgaacgaactttaatcagttgttgccagtaagcatcatctaatttttcatcctcgcctaaaccaaataagccttgatagaattcttcagtaaatacgaattccgcacgagcactttcagtttgtggcaagtgttgccaaatttcatcggcagtgaaagataagatcggtgccatccaacgaactaatgcttcagcaatatgccataacgcagtttgacagctacgacgcgcaaggctgtctgctttggttgtatattgacgatctttgataatatctaaatagaatgaccccatttctaccgaacagaaacgcattaaacgttgtaccacagtgtggaattgatagttatcgtatgcatctttaatttcattttgtgcatctaatgcacaagctaccgcccaacgatctaggctaatcatttcttctggtttgactaaatcacgttttggatcaaaaccattcaagtttgctaataagaaacgagcggtgttacgaatacgacgatagctgtccgctgcacgttttaagatctcatcagaaacggtcatttcgcctgtatagtctgttgaagcaacccataaacgtaaaatatcaccaccgaatttatccatgacttcttgtggcgtcactatgttaccgatagattttgacatcttacggccttgaccatccacagtgaaaccgtgagttaatacttgcttgtatggtgctttgctgtttgttgcagtagaaagcattaaagaagacataaaccagccacggtgttggtcggaaccttctaaatacatatcaatatcttgaccattaaattctaggcgatttgcaacaacagaagaataggttgatcctgagtcaaaccatacgtcaagggtatctggcactttgcgataggtttctgcatccgcccctaataattctttttcgtctaaatcccaccacgcttgaatacccgctctttctacacgtttcgccacttcttcaagtagctctaaggtacgcggatgaagttcttcggtttctttatgcacgaacaaggtcatcggcacaccccaagtacgttggcgtgaaatacaccagtctgggcggttttcaaccattttctcgatacgtgcttgaccccaatctggaatccagcgaacttgtttgatttcgcctaatgcttgttggcgtaaaccttgcgtttccatgccgataaaccattgcggtgttgcacggaaaataattggcgttttgtgacgccagcagtgtggatagctgtgtttgattttctcaacttttaataagttacctacttcttgtaatttttctatcacaagcggatttgcttcaaatacgcctttgcctgcaaagaattcggtcgttgaaataaatttaccatcattcgatacaagacccgccattggtaaatcatattgtttacccacgataaagtcgtctaaaccgtgatcaggtgcggtatgtactaaacccgtgccgccatcagtggttacgtgatcgcctaaaattactggtacagtaaaatcatagaatggatgatggaaacggcttaattcaagatcagcaccttttacagaacccagaatttcaacttgttctacgcccaccgcttttgccactgactcaactaattcagcagctaaaatcacgcgctcatcgccaagttggactaagttgtattctaagtctgcattcaccgcaatcgcacggttagacggcatcgtccaaggtgtggtagtccaaatgatggctgataatttaccttgtcctctaccttgtgcagaaaatttagcttcaatttcaaccgcactttccgcagggaaacgaacgtaaattgacggagaaactttgtcttcatattccacttctgcttctgctaaagaagaaccgcaatccaaacaccagtgaactggttttgagcctttatacaaatgaccattttcaatcactttacctaaagtgcggataatattcgcttcggtatcgaaattcatcgtgagatatggattatcccaatcgcccaacacacctaaacggataaagtcttttttctgaccttctacttgttccgaggcatattcacgacatttttgacgaaattcagccgcagaaattttctcgtttggtttgcccactaaaccttctacttttaattcaattggcaagccgtggcagtcccaacccgggatataaggcgaatcaaaacctaacgccgttttggatttaataataatatctttcagaatcttgtttacagcgtgaccaatatgaatgttaccattcgcatacggagggccatcgtgcagaataaaagattttttgcccttactcgctttacgaattttttggtaaagatttttctcgtaccaatttttcaacatatcaggttcgcgcttagctaaatcaccgcgcattggaaagctggtttccggtaggttaagagtgtttttgtaatcgactgtcattttattttccaatttttacattttaaaattaactgttaaaaaacgctttcgcagtttctacgtctttctcaatttgcactttcaaatcatcaaaagaggggaatttaatctcgtttctaatcttgtggcagaattccacttccaccatttggccataaatattctgagaaaaatcaaataaatggacttctaataattgcattaatccatttatagttgggcgttttcccatgtttgccacgccgttaaaaatctcccccgattttaaccgcacttttacggcataaacgcctttgattggatttacttgtctatgcaaacgaatatttgccgttggaaatcctattgttctacctaatttattcccatgaatcacacgcccgaaaatacgataaggtttaccgagtaaattttctgcaagttgtaaatcatcattcgctaacgcttcgcgaatcgcagtgctactaattcgctgtgcatctagacaaaaactacggttatcttcaacaataaaaccaaaacgcttactagctgcttgcaacatggcaaaattgccttggcgttttgagccgaatttgaaatcatcgccaatgcttaaaaatttcacatgtagatgattaacaagcgtttgttcaataaaaacatcggctggttgctcggcaaaagtgcggtcaaatttcgccacaattacgacatcgaccttagccttttcgagataataaattttgtcacgcaaacgcattaaacgtgcaggtgcattttcccccataaaatattcacgcggctgtgattcaaataacaataccgccatgggtaaatttaattcgtcagctttttggcgcaaatggcggaggacggtttgatgccctaaatgcacaccatcaaagttgccgatcgttagcgcacaaccttgtaaaacacgatttgcattatgaagcccacgaattaattgcatgtccttatccatgaaaagaagagaatttcggcattatagcgagaagttagttttttgtcagcaaatggtgcttgcgaacgcctaataaaatcaacgttgtgccataaactattgcggctaagacaatcaaccaaacaagccaataaacacgcataaagaaatccatttttgcccattggttgatttcaggcacgtaataccaaactgccgcacccattgcgattgcagccaataaaactttgacaaaaaagaccgcacttttacgtgaaaaatggtacacatccgctttggctaagccgcgatagagcaaataggcgttaagagttgcggacattgctgaagcaatagctaaaccaacatagctgaaaggaatcgccaatagattaaagcccatattactcaccatggcaataatgccaatttttactggggttttggtatcttggcgagcgtaatagccattggcgaggattttaatcaacataaagctaagcaaacccgcattaaacgcccataaagaataagaggcggcataaacatcatttagcatgaaatttccacgcataaagagcgtaagtaacatcggttgagccaatacagcaataccaatggcagcaggaacgccaagtaagaaaatcattcgcacgccccaatccattgtattacgaaaatcaaccgcacttttagctgaatcgccttcacgattaacgtggtggcgagcaagcgttggtaaaattacggtagaaatcgcaatgccaaataaaccgagaggaaattccagtaagcggtcggaataatacagccagctaatagagcccgtcattaagaagctcgcaatcactgtatccagcaaaagattaatttgacttaccgatacaccaaataacgcagggatcattaatttacgaattttggttacgccttcatcccgccaagcccattttggtttcaccagtaaacctgcttgtttcataaatggaatttggaataagaactgtaataatccgccaagaaaaatcccgatagccagtgcaagatctgggttatccatttgtggtgcaaggaaaagtgcggtggcaatcatcgctatatttaataacacgggtgaaaaggacatcacgccgaattttccaatcgtgttaagtacagctccaaaaagcgcgacaaaagtaacaaaccataaataaggaaaagttattttaagaagaagagaggcttgttcaaatttatgtgcatcagggccatcattcatccaatcggtaaaccagcccatcccaaataaagcggcaacgacaggcgatccaaccatcgcaaggatcgtaacaatactcaccaatcccccaagggtaccagaaacttttccaataaattcacgggttttattcatatcgccagatttttgatattctgcgagaacagggacaaaagcctgtgaaaaagccccctcagcaaataaacgacgaagaaaatttgggatacgattagcaaataaaaaaacatccgccgcagcgccagccccaatgagatgagcgataactacatcgcgtacaagacctaacactcttgataataacgtcatagaactaacaacaatgctagattttaaaagtcgtttactcaaaatattcttctctaccctaaaatttttgcctaattgtatagaaattttgtttttacgctatattccgtgaaaaaaaactgataaaatccgccacacatcgtttgtgtgagcccatattgaaagagcttgtaaaaataacgatacttactttcggttgtgtctcaccgaaatcaacacaaattttccattgacaaaagtataaaaaatcggcatattgacgccctttattttgtctatcaatcaacagaaattttaggagtttgaccttggctaatatcaagtcagcaaaaaaacgcgcggttcaatctgaaaaacgtcgccaacacaacgcaagccaacgctctatgatgcgtacttatatcaaaaaagtatatgctcaagtggcagcaggcgaaaaatcagcagctgaatcagcattcgttgaaatgcaaaaagttgtagaccgtatggcttctaaaggcttaatccacgctaataaagcagcaaaccacaaatctaaattagctgcacaaatcaaaaaattagcgtaatttttagctagaaagaatgaaaaataaaaccgcactttaaagtgcggttttttattgcatcgaattttagactaaagtaacaacatcgatccccatttgataatatcaaagaagaatttattttgattggttgcaatgccatcagaattttttggtgtgccatcttcatttttttgcacttccaccataccatttttatattgacctttcacgacagccaaatcatcgtgcgcttcgttacgcaacttcaaacaagactgtttagttaaaggttcaacattgctcactttggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcggaaagttggtaatcagccccagcaaattccgctggaattgcggattgttgactatcaaacattgaacagccagacagcaatgctgccatacctaaggttgcaattaatttcacatttgatccttataaaagtgagaatgcacaaaattctagcaatatcttcacaacagataaagcagcaaatgaatttagttttcctgatctgaaaaacttccgctataatgaccgcacttttttacgttaattaaaaggaattcttatgcaaaatccaaaagatgatgtgttatatgcgcctgttgaatgggtcgatcacagtgaaggctatagcgatattcgctatcataaatccactgatggcattgcaaaaattaccattaaccgcccagaagttcgtaatgcgttccgcccacaaacagtgaaagaaatgatcactgcattttccgatgcacgtttcgatgaaaacattggtgtcattgtattaactggcgaaggcgaaaaagcattctgttctggtggtgaccaaaaagtgcgtggcaattacggtggttacaaagatgacagcggcgtacatcacttaaatgtattagatttccaacgcgatattcgttcttgtccaaaaccagttgtagcaatggtggctggttatgcaattggtggcggtcatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatacggttgtgccttacgctgatcttgaaaaagaaaccgtgcgttggtgtcgtgaaatgttacgcaatagcccaatcgcaatccgttgtttgaaagcagcattaaatgcggattgtgatggtcaagctggtcttcaagaattagcgggtaacgcaacaatgttgttctatatgactgaagagggtcaagaaggtcgcaatgcgtttaacgaaaaacgcgccccagacttcagcaaattccgtcgtaatccttaattatccgtagttttttatatttataacgacactcttgccttcccctgcttgcgggggaaggtgcccgaaagggcggaagggggctttatatcctttctctaccttcggcagctctccccacaagcagggggagccaagcgtttttgatagaataattcaaggacgtaaaatggcacaaaaatccttcaatctttaccgttattccatccccgttgatagccaacttattctgcgtgatcgttttttaaaacgccgtgaaggcttaatcgtaagagtgagttgcagccgagacggttggggagaaatcgccccactacctggttttagcgaagaaaccctagaccaaactcaagaacaagcaattgaatggctaacgacatggtgcaatgcaagctgtgacgcacctcgcgtaccattagatggcacctatccctctgttgcttttggtatcagttgcgcaatggatgaaatgaaaggttatttacaagccgaaggcaattatcatacggcaccactttgttgtggcgatccagatgaactgtacgccaaacttgcgagcatggaaggcgaaaaagtagcaaagatgaaagtgggcatatacgaagccaatcgcgatggattaattgccgatatgtttttagaagccattcccgatttacaattacgactagatgcaaaccgacattggtcgttagaaaaagcgttacaatttgccgctaaagtcaaaccgcaacatagaaaacgtattcaatttttagaagaaccttgtaaaacacaagaactcagtcgtgaatttgcagctcaaaccgacattgcgattgcatgggatgaatccgtgcgagagcctaatttttgcctggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttaggactctctcagctcgcgcgaatcgcacaacaatacaccccgaatgtaactccaggcttagacacgttagatttgatggaatatcaagtactacgcgcttggcctaattctaatttacctattgttaatttagaatctgaatttatcactaaaattatctgattcgaccaccaaaaatcgaaaaaccagtataatgcgccacacaaaaaggattaaaaatgtcgcaaacacacagaattttgctgttaaatggcccgaacttaaatatgttaggggctcgcgagccaaaacattatggcagtatttctcttgcatccattgaagagaaaatacaaacattagccactcagcacaatgtaaaagtggaatgttttcaagccaatagtgaagaaaaattaattaataagatccacgaaagttttcagcaagtcgattttattttaatcaatcctgctgcctacacccataccagtgtggcattgcgcgatgcacttttagccgtttcaattccttttgtggagattcatttatccaacgtgcataaacgtgaaccatttcgtcatcattcttattttagcgatgtggctgaaggtgttatttgcggtttgggtgcaaaaggttacgagtttgcctttttatttgctattgattaccttgctaaaaaataagaaaatcgagcatttttggcgaaattcatagaattttatcgcaaatttgcaaaatttgaggtaatctctacaacaaaaaaacaagtttattcataaccgcacttttttcgtttaaaagtgcggttaaaatttcaatctttttaggaagaacgtatggacattcgtaaaatcaaaaaattaatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataatttccaatattttcgtcgggcggactttagtccgcctgtttcatatacaaataattagagcgaatttatcgtaggcgatataaattgaaatctgttcacaccaaattttatagggagaacaatatttcaataacctacataaaaattcacgtctatctgactaaacggactcttttatgttagaaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctatcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataattaaacgttaaatggctaacaatggttagccatttcttatatatgccgatatttatttaatgataataaaaactaaagctagtaaagcgttttgaattattcaaaaaagttgtaatatgaataagtataaggggcgtaggatatatgtgcctcttataccattcaaaaaatatactttcacttataaaaatttaaggaagaaacatgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgcttttttagtaggtaataaattgggcgaacgtcgaatcgaaaaaactcaattaaaagctaccgcactttaagcgtcaatcaatatgctgtcaccttcttctaaacttagaggaaggtgatatttaattttctcactttcagcaatttctaggctaaaacatagaattggaactattcacagggatacatcaatgctctatcaaattctcgcgctacttatttggagcagttcattaatcgtcggtaagctcacttattcgatgatggatcctgtgcttgttgtgcaagtgcggttaattattgcaatgattttggtaatgccactttttttgcgtcgttggaaaaaaatcgataaaccaatgcgtaaacaactttggtggttggcattctttaactataccgcggtctttttattacaatttattggtctgaaatacacctctgcgtctagtgccgttacgatgattgggctagaaccgctacttgttatatttgttggacatttcttttttaaagacaaagcaaaatggtttcactggctattcggcgcaatggcatttattggcgttgcaattttaatcaatggtggaaaaaataatgaaggcattgataatgttagtttattaggttgcttattagtgctaagcgcagggattatttttgcgactgtattacgttggacgcggcgagttgttgccaaagtttcaacgcaagtttacacatccatcagtattgttcttggtgttataacaacattaccttttaccttattactgacagaaaactggcaaatatcattaaattccacgggaattgtaggtttattatatcttgcgcttggttgtagctggcttgcttattggttatggcataaaggactcaataccgttgatgctaatatctctggtattttacttgcacttgaaccattattcggaatcttatttgccgtatcattacttggcgaaacgctgtcattttcagccgtacttggcataacaattattatgttagccacacttggctcgattttactaccgaaacttttgaaaaaatcggtataatacgccccattttatgaaataaaggaaaaaacaaatggcttggattcaaattcgcctaaatagtaccaatgaaaaagcagaacaaataagtgattttttagaagaaatcggatccgtttctgtgacttttatggatagtcaagataccccgattttcgagcctttaccgggcgaaacgcgtttgtggggcaatacggatgtaattgcgctatttgatgcagaaacagatatggcagaaatcgtccgcttattaaaagaagcaaaacacttagatagcaatacggcatacaaaattgaacaaatagaagataaagactgggagcgagagtggatggataatttccacccaatgcaatttggtaaacgtttatggatttgtccaagttggcgtgatgtgcctgataaaaatgccgtcaatgttatgcttgacccaggcttagcgtttggtactggtacgcatcctacaaccgcattatgtttagaatggcttgatagcttggacttaaaaaataaaactgtcatcgattttggttgtggttcaggcattttagccattgctgcattaaaacttggtgcgaaaagtgcggtgggaattgatatcgatccacaagcaattctagccagtcgtgataatgccgagcaaaatggcgttgtagatcgcctacaactgttcttatctgatgaaaaaccttctgatttaaaagctgatgtcgtggtggcaaatattcttgctggcccactcaaagaactttacccaatcattagccaacttgttaaaccgaatggcaatcttggtttatcaggtattttagaaactcaagctcaatctgtctgtgatgcttatacgcaaacatttgcgttagaacccgtcgcggtaagagaagaatggtgccgaattacgggtaatctaaaaacgctttaatttctttttgtcaatcaaaaaaagtgtattttttaaacaaatttcactttgcaaagtaaggcaaaatgcgtattatagccagccttgtcggttgtcgagcagttcaatataaattagatttaggcttgctaggaaggtaacgtaaaatgcgaatcggttcataccaattaaaaaatcgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattgttataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataaggcgatattcttttattaacaaaaagattgaatgtttttcattctattttaaaaattagccccaagtaatttgaatttggggctaatttattattacaatttaagatcttcgatgtgcatttttcataatgcgatcttttgttactttccattcacgttctttaatatcatcacgtttatcctgttgttttttacctttggctaaaccgattttgacttttgcccacgcacttttccagtaaagagaaagtgcaactatggtaaaaccgtctcggtttgctttgccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttattcagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgagaaagataaaaagatgaattaagtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaatacggtcaaaagcacaaggagaaccaccacgttgaatatgccctaaaacggttgcgcgagtttcgtgacctacgcgagcttcaatttcttttgccagagaatgaacatcagttaaaagttcagtgatagcaataatagcgtggcgtttaccgcgaataatgctacgttcaatttgttgaattaattcttcgcgattaaattcaatttctgatgcgacgatatattcacaaccgccagcaatgcccgcagaaatcgttaagtcactacaatggcgacccataatttcaacgatagaaatacgttggtgtgagcttgatgtatcacgtaaacggtcgattgcatccactgcagtttgtaatgcggtttgatagccgatggtatagtcagtacctgcaacatcattatcaatagtaccgggtaagccaacacaagggaaaccgtgttcttcggttaataatttagctcccatataagaaccgtcaccaccgataaccacaagtgcatcaatgccgtgagaacgtaaaatttctgcacattttgcacgaacatttggatctttaaattcaggaaagcgtgcagaacctaaaaaagtaccgccacgattaattacatcagatacgctatagcgatttaattgtttgattttattattgtataaaccttggtaaccatcatagataccaaacacttctaagccttctgcaagtgcagagcgtactacgccacgaattgcggcattcatacccggcgcatcgccaccacttgttaaaactgcaatttttttaatcataatttacctacttttaaccataattgaaaatgggcataagattacatcattcaaagaatctgctctagcaaaatttgacgagattttgatctacattatttttcacaaaacagttgccatttcaaattttgtaaatgttttctttctatatccacaatgtatttttgcaaatgttgttgtactttatcgacagataaatgtttagaatgcgttggttgctgtattttctgcgaatattgaaattgcacaaagccacattggggcaattgtcgtcctttcatcacattgacttgccaagatggattttcctttgttggcgaatagatgacatatccatttaattcatttggattggtcgaattttctggaatagtatcaaaatgaaaatctttcacgtctgtattgcgataaatgcgttctcttaatgcaatacgttctttaatagaacgttcggattgattgcgatcaaagagaatttcaatttcagattgccaattttctagcgtatctggcttagatatatacgcatagcgtgcaatggttcctaaatcttggctgccagtaagtacataatgtttgccattatattctaactgcgtaggcacatttaattgggtcagcttagttgcacagcctgaaagtataagtgcggtcaaaataacaaaaattttattcattaatatctcgcttaaagacaaattcagtttcagtggaggatgctgaatcaaaccaataaccacctaaatcaaattcttttaactgttcaatgtcggttaaacgattttgaataagataacggcacattaatcctcgcgcttttttagcataaaagctaattactttgtattttccatttttattgtctaagaaaactggcttgataattttggcgttaagttggttttctttaacagatttataatattcatcagaggctagattgactaacacattatcgccttgtgcatcaatagcttgttgaactgcttgggtaatcacatttccccaaaaggcatacagatcttttcctttcggattggctaattttgtccccatttctaatcggtaaggttgcattaaatcaagtggttttaaaagcccataaagcccagaaagcatacgtaaatgggattgtgcaaaaatgacatcatcttccgaaagggaatcagcatctaaacccgtataaacatcgcctttaaatgcaaagagtgcagggcgagaattgtcttcattgtgaatttttgtccattcagcaaaacgtgcaacattaagccctgctaatttatcgctgatagacattaatgatgaaagatcttgcggagaaagtttacgacaaacctcaataagttgttcgctgtaatcagtaaagtgcggttgaaaaacaggaaaattttttaccgcactttcaaaatcaagggttttggcaggggagataatggctaacataatcgtccttttatgaaaaaagaatgggcgtatcttagcataaaaatttacgttaaatgcgtttatataagccattttcacttatgataagatcttgtagctcaagatcgagcaattgaacaagtaaaacatcgacacttaaattaaattcttcagctaaatcatcaatgctcacaggagtatagccaatacgtgaataaagtttcgggtggcttggtgcttctactaatcggcgaggatcgggtggtggcgtgtaattaggcacggcgatctggtcaaaatcaatttcagtttggctgtggatagaatgttggtagagcgtttccaaaatgtcctttgcattttctaccaacattgcgccttgtttaatcaggcgatgacaaccttgacttgattcattttgaatattgcctggcacagcaaaaacctctcggttttgttccaacgcataccgtgcagtaataagtgatccacttttttcggtggcttcaacaacgagcgtgccgactgaaagcccactaataatccgattacggcgtggaaaattagcagcaataggtgcttggttaggtaaaaattcagagactaatgccccattattttcgatgatttgtgctgataatctttgatgtttagagggatagatttgttctaatccactgcctaagaccgcaatagtttgcccttgaatattgacgacagcctgatgacaatgaccatcaattcctaatgctaaaccgcttgttatggtaaaacccgctaatgaaagttctgttgcaaaatgttttgcccaatattctccataagtcgtgcaataacggctcccaaccattgccatttggcgttgtgaaagtgcggttaaatttccttttacaaataatagtggcggaaagtttgcggtttgtttcaataaaaagggataaaaaggggaaaaataatttactaaatgatttccctctttttgtgaccacgcgagtgctggctcaataaattttgcttcaggtttgaaccaacggcgaatttgaatggctccccatcccatttgtcggaaagcaacatcatcataattaagtaattcatttaaggtaatattggacaaaattttatcaatgccaacgccgccaagtttaggcacttgcattaaacggagtaatgtgtaggtaatgtcattcatattttttcctttttatttgaaagcctagtatgggaaaaacgagggaaagaaacgattaatttaaaagcattttgcgatgtagatcgcaaaaattctttttaatgaataaaaaattgcaaaatttttcttattttgaaaatgtaaaaaatccaataagaaaaatttgttgatgacgattaaattggttaaatattctgattttattaaatttattagttaaatatatatttaataaagtgtgagtaggtttatttttaatataaaatgccaaaaaatagtttgacagccagttttttattcgtaatatggaaaacgttttacacagaaggatttttatttatgtttcgtattgtttctttatctctcaacctgctgctctcacattttgcgtgcggctaagttgtggataaaaaacagtcagatgtaaatacccaattttaaacccgcactttataagtcgcgggttttttgtctaaaaaatacaggaaaaacgcaccgcacttttggagtgattttagaggaacttttagtaaggatattgttatgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttatctcgagccgtagataaagacattgatgccgcataccaagcattgaaagtggcagaagcattccgtattcatacttttattgcaagctcggcattacacgttgaagcgaaattaaaacgttcttttgatgatgtggtaggaatggcagttgcagcagtgaaacgcgcacgtaattatacggatgatgttgagttctcttgcgaagatgcggggcgtacgggcattgacaatatctgtcgtattgtagaggcggcaattaatgcaggtgcaactacagtaaacattccagataccgttggtttctgcttaccaaatgaatacggcaatattattgctcaagtgcgtaatcgcgtgccgaatatcgacaaagccgtgatttccgtgcattgccacaatgacttaggtatggcaaccgctaattctttaaccgctgtacaaaatggtgcacgccaaattgaatgtactattaatggaattggggaacgtgcgggcaatacttcccttgaagaagtggtaatggcaatgaaagtgcgtcaagatttcatgggcgtggatactcgtattaatacccaagaaattcatcgcgtgagtcaaatggttagccagctttgcaatatgccaattcagccgaataaagccattgtaggctcaaatgcttttgcccattcttctggtattcatcaagatggtatgttgaaaaacaaaaatacctacgaaattatgtctccagaaaccattggtttgaaaaaagaaaaattgaatttaactgcacgttctggtcgtgcggctgtgaaaggtcatatggcggatatgggctacaacgaacaagattatgatttggataaattgtatgacgcgttcttaaaattggcggataaaaaaggtcaagtgtttgattatgatttggaagccttggcatttatcgatatgcaacaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaacccaatccccctctttagtaaagaggggttaggggagatttggcagaagtaacatcaacctcagtggtgaattttatatcgttaaaatctcctccagaccctcttcacaaaagatgagagaaaattaaccgcacttttgcagtaaaaaataggaaaaataatatgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaatacttgccttcctccgtttacgggggaaggtgcccgaagggcggaaggggggcaatctcccacccttagttatttagaaatatccccaataaacagggggacaaagtatttaaagtgcggctgaaaaacacgtcgaattttaaccgcacttcccttaacgaatagagaaaaacattatggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaaggctcaataagaggaaaaagaaaaatggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaaaaataaaaaatgtgctgatttttcaccgcacttaatcactgaatttcattcaaaaataaagccctgtaatacacagggctttgtcgtttataacgctaattcaaacaggctgattaaaaactaaaacttagtttcacttctgcagttttttgtttttccgcttgttttgcttttgttaatccgccaattagacttaatttcacattatgatatttcaatttaagtcctgcgttatattgctgttggttttccacattgtaagcaaaatcatatctatctacattaattttgccgctgccttgatttgcatcatatcgagcagacaaaattggcgtaatggaaaactcgcctaagtgataagtataacttaaatcaacttgagcaaaggctgttttgacagatattggatttactttaatgcgatctttagctaatgcaaaattagcgtttgataagtaactataacgaacccctacagttggtttaacagcaaaattgccaagattaaatgctttgcctgcggttaaaccaaattgtgcagtatggcgagcaaatttcgcattatgattagtttgtaagttgctttggaaattaccatagcctaaatccaccgctaaataccaatgattatccatataatatttagaatagagatttgcttgtgctaaggtatttttactgcttgccttatcaaagttgttactattgcgaacataagtaaacacaccacctaactgaacattgcttgagattgtttgatcccaaccaagttgagtttgcgcacttttagaactaaaatgacgatattgacttgaggaataattttctttcattgaagtattagatacccaaacgttatattgcccctcgttattcatttctaactggctaatatgttgagaaacggctttccctacatttaatgcaacaaattgtgcttttgccatggcatcagaaattaccgcattggtgtttgtacttgtgagatcgcgcaatactagttgtgtagccacatcatttcccgattgcggattctccgcattttcagtatgtagttccactggctcgtaactattctgagctgatctacgagttcttctgcttcgtggttgtggagtagatcctgaattatccactgttgtttcttgagtagaagctactgttgtttcttcagcagaagtcactttagactggctaacaacagcttctgttgtcgctgtttctgattgaactgcctctgaattaaccgtagattgagttgtagcaggtgttgtattctctggatttttcactacagggttttcagtgcttactgttgtggtttctgtcacaggttgttcagcttctgtagttttattctcaacaggtttaataggtgttgtagcattttcaggtgtaacaacttctgttgaagcaacagcagtgtgggcttcaggctgatgaatattttcatctgtcgtttctgttgattgaggattttctgctttattttcagctgtttttggattagctacaggttgagcagtttctttctgttcactgtttgatgcagttgtctctttcgcagcaacagttgtaggttttgcttgcggttgagcttcttttacattattaacagtcgaaacattttcacgagcaggctctgcttgctgtgtggtagtttctggctgtgcttgcgattgaacagttttaggctgttcttgctgtttagccatttctggttcttcttgttttggagacgcttgaaaagccacttgaggggcttcttgagttttctctgtttctactttagcagtatcttctgttcctgctagatttatattattagaagacgagctaatacttcttctaggtctgctctttggttcactgattgtaggatcatcttctactactgtttcttcagtagaatttatttcagactgacgagcagtttcagcctcttgagtttcctcggtttcgcttccattttgggcgagttcatttgtttgagtgttagcttccacagttggtttagcttcttttgcaacttcatcattttgagctgttgtctcggttgctttttgctcgtttttcgctactgtttcactttcttgcggactattttcagccactttttcaattgtctctgatggaacactttctgaatttggatcatcagcctgtgttgtatcagcttgtggttcagatcccgatgggtgagtagtatttgtatcttccattgtaggttgaacggtttctgcaggacgagtttctggttgctcgtttgccattgctgatccagtagcaggtgcaggtggtgctggcagtggaattggtgcttcaacacgagcggtttcttcatggttatttgatacgctaggtacatcagcttgcatattattagctgttgcaatacttggcgtatcgacagtttgatttcttctttctacttctgggttatgcaagtaataacgtccactattttctttcaaagtatagctccaagcacctcgatcaactttgccattagccagtgaaacatttaagccacttctttcagttgcatttgacgcatcaaaaagcgtaagttcattatgatttggctcgcctgttttatttgccacttgtaatgtaaaggtacctttggctgatttggttacaacaactttgtcgccctgatttttggtaaaatcaacccaataatagaaagaaccattacctgataaattgctaatattgagcgtgtggtattttgtttcttttgttgcatctgagacattatttaaatgaatatgcccatttgctagatctaattgatgaacatcactatttcctgttaaataccaatggctgttttcttttaaattaacttggctattttccgtgctgttaattgtgccaaataagttagctttgcctaaggtaaagtttgcactttcggttaaatttacattaccgcgcaaattagttggattaaaactattgagtgcttttgtagataaagtgtcattatggcaagtcacatagcccgtatagtcagaacgtacacaaacggtatcgcctgctttatagccgatatgcacttttgctttattagaggctgtgatatttgaagtaatactttcaacattgcgacctgaataaagggttgcgttattggttacattaatatttgttgctttaaaagtgcggttaatccagtcgtcttctaccaccacttcattattttcagcaaagtgtttatctttttctgttgaagaaatatttgcaatatctcttgcgtgtggtgttggtctgccagaaaggaataatgtacctttttcaacttttaattcaccgttaaggtttgttccgccagtcaataaaaagcgattttgatcacttttgccactaaaggtaacatttaatttaccgttttgatctgccttagttgcttcctcgccaaaataaccattaaagccattcatacgtctgttattgatgtacaccatggctttcttttgtgcatcattttgattgtcgcccatgaattcccaattagcatctgatttttcagagctatagcaaggcatttctgcagtagggcttccaccttgctttaacgcatagtatttataacaggtattactaaagtaaagatcttttcctcttggaatagatggcacatagtaataattatcatcatcggcggttattgctggtgtatatatagtgacctgacttggatttgtaattaatcctgctccagtaatcgttatatttgaggcattagtcatattatgattaactagtcttgcaccatcatcaatattacggatatgttcaaaagtgagattattgccattggcatctaatcgaccgcctctaaaaccaaagtaaattgaatttggatctacttggttatcatcattaagtacaacagttgagcgaccacttacaattcctacagaagcaaaagcgtgttgtcctgtagttgtttgttgttttaaaacaactgtgccatcgcccacttttagcgaacctttattatctcctcttccttcaacaattagctttcctttaccaattttagctaaacgatcaaattgagggttatgcactttccactttactgtttttccttcagcaacagatataccagcccctttccaagtcgtattttctgaagtgcctttaacttcataatcaccttcaaagaacaatccgcctgcaccttgatcgatattattatttaaggtaaggtttccacttccttcaaacgtaacatttttcccatgattgagatttttattatccactaaatcaacacttaatgattcagatgttccagatatcaagcttgtattacctttgcttgtccagttatattgcgtattacctttcagtaaaccagcactgtcttttttgagaatattttcagcaaattgtggtttataaatattccattcttgccaagattttttcttataccctccccaaaaatcataagcaccaaggaaaagccatttctctttagatttatcataaacaaataacggtgagccactatctcccaagacagcataattagtaagcggtttacgagataatatctcttttggatcgttatgatcttcggttgaatcaccaaacccaatgagtccatcgtctgtatgattcactttataaggcgtgcctgcaataccataggtataagcgttaccaactaatttaagattatctccacctacatcccatctgtgtattatttcctttttctcgtttttctcttctaaaattaattcataatggcttccttttttatagataaattgagagccacttcctaatctcacaaaagcaggatatttattctgatcattatatgttccagcatcactacttgtagttgaagcctctatcggtgcaacttcggtaacaaatttatcaaggcgtggcatataataatcttcacggcgtttttggttttgctgttctttaactaaggcttgtccatataattcggaaggaacatcttttttattagatgtatactgtttatctttttcgttattttgtgtttttccgtttaattcagaagaaaaattatttttttcaacagtgtaatatctgttttcctcccaagatacatctcgatgctgaatagaatttccaaatttagggttccaattcccatttaaattcccaaaatgtagttcacccacaccgttaccaacgtgttttacccccacaacatattgtggatttaccaacgtggcaattctcttatctacatccacagcactaaaatcaatcatcggaatatctttaggtagcgcactgcccaaattattatttttgttatctctcacttccacatttgttgcaccaacagaaaacttccctttattctctgcaaaatcacgaaatatttgataatccacatcgtttctcactaacgcggcttctgtataaggggttaatgcgtaggcgacagtaagcgcaataaaattgagtttgaattttttatttagcatagaagctgtccttattaattaagtttaaaaagtagatttgatatacagctacaagttgattcaaatcttggctgtgttgcgttgatagtttgcaagttgtcttcatttttataatgagtgggttttatagcataaatcgctcaaaacttgaattacatttattaggtaatgataatgatttttgatattttttaaaaaattggcgtattttttaccgcacttttggttaatttaaggcgttaatgatgccattatggacagaaaacatttttttgttttccacttgcatttcttttagttgtctttgagtgatggcggtaacaaatacttgcgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatacacacattaaaagtttaagctgtccacgagaaagcacatcttcaacaggcaatccttgtgctttgaaacgaaaatccgctttttgagggccagaaaaggtgtaatttaaggcacgatctcgttcaaaattttgttgaagaatttcataataatcagcatttttttcccacccttgatgaaagctgacattaatttctaattcaggcagaaaaagttggcaagtttgttcaatttcagggcggagagcttctgcatattcggcacgccattgacttacttggtgggcaagtttggcaagttcaacgtcccaaatttttatggcagagtaaggctgattttgtgcgagtgcggcatttcgttgtttaagtaatcggttgagattgctccaagcggaatagaaacttgtttggtggtggaataatccccaatctaaaaacgcacgacgataacttggcccaccgttgagtaaggttaagccctctggcgtgattaattgcattggtaaaagatgggctagatcggaaattttattgccatcttcgccgttaatttttactaaggtgttgccttgacgaagtttttgtaagccgacagaccattgatgttggctttcttggatttgtccaaatagggtaaagtgcggttcgtcgtaagaaatgatgcggtttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcgcattcgcacttgattacatttaagtgcattcagcacatcaagaatataggtgacattaaagcccacttctaattcttcgccattgtaattgacatcgacaatttcttctgcttcttcgtgttctgtgtttgaggcagtaattttaagctggttttcctttaagcttaaacgcacgctgcgcgctcgttcattagataaaatggacgcacgaacaaaagcctgtttcagcatttcccaattgccttcgacagtttttgtggcattacgaggcaatactcggcgatagtcaggaaagcgaccatcaattaattttgatgtaaataccgtgttttttaaatggacacgtaaattgttggtgccaatttgtaaacgcgctggttcatcgtttgtttctaataaacgaaccagctctaacacacctttacgcggtaaaatcacagaatgattttgtaattcttgttcaagggaaatggtacacaccgcaagtctatgaccatctgttgccaccgttcgcaataaattgccttctgtttcaaacttcataccatttaagaaatagcgcgcatcttggtttgccatagaaaattgagtggcttcaattaaacggcgtaaggtattttgcggtagttgaaaatccacttcagactgccaatccgtgaggtttggatattcttcggcaggttgggttgtcagcgtaaaacggctacgcccagactgcactaaagcacggtcttgttcaaaagtcaccgtgatttctgaatcatcagataaagtgcggcaaatatctaagaatttttttgctggaatggtaaaagtgccattttcagaagacgatgaaagctgagtttgactcgataattcgacttctaaatctgtaccagtgatagtcagacgattgtcttcaatttgcaacaatacgttgtttaatacaggaatatttggacgattactcaatacgccacatacttgttgcaacggttttaataaattttctcttgaaatgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtctagcgaaaagttctttgctgttttatatctttttcaattttagattatgcggacaaagtgcggattaaattcgcccaatcttcttgaatgctattgtcttgctcgcggaattttggcacttcacggcaagcgtttaatacggttgtgtgatcacggtcaaaggcacgaccgatttcaggcaaactgcggtttgttaattcttttgctaacgccatggcaatttggcgagggcgagtgactgaacgcgcacgactttttgattttaaatctgaaaccttaattcgataatattcagccaccactttttgaatattttcaatagtaaccaagcgttcttgtaaagccaaaatatcttttaaggtatcacgcacgaaatcaatatcaatgtcaccgcctttgaagtcttgcattgctttcactcgatttaatgcaccctcaagttcacgcacgttggtacgcaagcgttgagcaatgaagaaagcaacttcttctggcaagttcatattatgttcttccgcctttttcaataaaatcgctacgcgagtttcaagatcgggcggttcaatggctgttgttaagccccagccaaaacgtgattttaaacgttcttcaattttttcaatttctttagggtaacgatccgaagttaagataatttggcgacccgtttcaaataagttattgaatatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgcgcattcggtttatcggctaaaatgccgttgccaatggcgtgtaacaagtgagttttccctaaaccagtgccgccatataaaaagaaaggattagccgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatatatttggcgtattttctactactttaggtgcaggcttgaccccttcttttaaagaaatacgcagttcaggattttgtgtaagtgtttgacaaatttgctggatttgtgcgagataatgggtttccacccaacctttcacaaacatattagaagcatataaaacaatgtggttatccgccaccacatcagcctgtaaaggacgaagccaagtgctaagatcgctggctgaaacttgatcttgaagttgtaacaggcaactttgccaaagatttgagagattcacaaaaggatccttgttgtttttattataaaagtgcggtcaaaattgtcggagattttacaataaatgtgtgaaaagatcttctaaaaaatctagtgttgagttttcatttcataagattatagaactgaaaagaaatgcgccagtgcgatatagatagcgtgcttaacctgtctggcgcattttaatttagaatttcatttctaatgttaaggtatagtttcgtcctgatgctgcgtagcgagtataattaccaacattttgatgttgattgaccgctccttgtgctgtttgacgcaccgcttcccaagtgacatagcgatagtttaataaattatatactcctaatcggaacaaaatacttctattcaccatgtaataacccgatacatctaagatatgccatgcccgagtaagttttcttgttgattttacaccccttgaagtgttacctaatgaacgttgtcctagcaattcattttgagattttgcttttgattgagtaaacattgtattaattccccaagtattacttggatgatcatagcctaaaccaatgatataacggctgggctgaatggcatcaaataaataactgcttacggaggctaaaccagcattgattttttgatctttaacttttactcggttataagcaaatgttgcataccaaccgtagggaatacgtttccataaaccattaaaatctaattgcgcagttatatttacgccaactaattttgcattttgtgcattatgatatccataattgcccttgccctttccatttttaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccatccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataataatttttccctttaattaaccgcactttacagtcactataattagaggagctaccttgataattacaatgatctcgtcctacaaaagatgcatttggttttgggtataagtaaggttgtaatttgaaaccatttcttcttggtgtttcaccaggtttctctgaaatactctttgccgtagcggtaacacgtcgagttaaataatctttatgctgaagcgctgaagtaaagtcatcaaaaccaagattgaagacaatttgatgagtaagccaattttgttgaatttttttctctaaattcaattgcaacatattatgtttttctttataaacatttctatcagaatgatagtatgaataaggtttatcaagtgttgggcggcaattcttacttggattaggataaagactgcaatgtgtatgttgcatataactgtcaagtataatgttttgttgattagcacttaacactgctttgtcaatgattcccgctttgttcttattttcgtaaatatattcaatacctacacgctgttttctatggtgttcatcgaaataaagcccacttgcatatttaacgcctcggccatcctcaatacgttgatatgcaccataatcttgctttggataaaaagaactattttctaaatccggtttttctgttgatcttaaataagcgggaaatgtcatatcacggatatcaaatttttgttgtgtgaattcaaaaataccaccaatataatgttgttcagaaaaatgatagcctcctcttaaaaaccaagactggctttcatatttcattggattaggtttgatacggttagcccccgtataatctgaaacgcttacggtttctctttgggaggataacttcgcaggtggtttggctgaaggtatacaactgttataatcctttggacactcatcttccatcacaaagtatgcattagatccatcttctttggcgattaatcgattataactttgcacgccttttaatgcatctttatggacttgggtttcaattgaatttcgttgagtgtaaatagcaagtccttcaaatccaccttgttttcctgctacagctaaagaatgggtaaagcctttatttttgcttgaataagcatttttagtttgaattccccatgatttgtctccttctaagatatcggctgcggatttgctttgaaatgttacagaaccagctagtgctccattaccatactcagaagaactcccccccttgcttatttcgacggcctttacattttcatattcaatttcattaattgcaccagtgccagaatatcctgaacgagcaactaaagggctttgcactacataagattgcgtttgaggtaaaccatctactaataaagcaactctatttctgtccataccacgaatagaatatccagaacttgcaccgcgaccttgttctacaactgaaatccctggatcatagcgtgttagatcacgaatatttaatacttgttctcggctgatactttcactagttttgataattttgccaagtccagttacttcattatctttacgatctcttactttttctgcagtgactgagatagtttctaattctgaatcttctgtactttgagtgtccacttcagatgatatagcttcttttgtatcttttatactttgagtttctgcttttacatagcatgaaattaaaagacaagaaataatacttaggcgaaaatagggttttttagtcatttttagtattccattatttgtttttttctacttgttggttgtttctacttgttggttttttctacttgtcttttagctccaaagacaactgcagctcttgcatttggtgaattgggtggtgaaggtacggttgaggaactttcagaatttgtagctgtaggattgtttccgttataggtgaaataaccgcctaattctgtagcgtgcggaccataaaatgccccgtttactgttgtcgtgaaattgactttagatgtggcttgtgtatttttgggatcaatcactacatttgcggttgctttaccttcgaaggcattactaccatttttaaaggttgcctcaatgttaaacacggtattttgtgagtcggctcgttttaatttgcctgttaatgttttattgtcaaaattgacatcaaactcggcgggagcatttttatcttgttgtttatttcctgtagtggagtaagatgtcttgtcatcaccaatataaccaaaccaactaccgagatatttcacgtttcccgttacaggaatttgagaactgggagtacggagacctaacaaaaattggtggtattgtcctgtttgatttgtgtttttcttctctttatcctcataatacataccaaattttacatagcttagattcttgcaacatgcttctactttataggttttatttccaatatcgtgatgtttactcgttacgaagtcatcagtatccccttcagggaaaagaggaacagggtaattatcaattaaaaggtaatcagcttcaccaaaacttgatatatcttttgtcgtaaagtttttttcatcggtttttacatcggctgttgtactggctgttgtactggttgttgcatcggctgttttagtagagaaagtaattagcttgccatcaattaaggtttctttggataatttttccttttctgtttctggcgtttctttggcactaaataccccaaaaactcgtttatccctagctaagaatttaccccctagttcttcagcattaggtccataaaaaccaccttctaatgttccctcgctggtaaagggatgttcatccgatgtggatttcgtaggagtaactttacccctgaatctattactataaatatgggcatctatatcatagagtttttccttttcatattgttgaatatcagtttttcttttggtgtaagacagttgtcctgtcagttttttagtcccaaaatctgcactaaattcacttattaagcctatatcaccattctttgaattattttctaaatcaatatctcctcgagtagcactacgtcgaaaataagcttgacctctagcattactgaacaaagaataattttggccatatttagttgcagtgatgaaatcccaagttcctttatacgttgctacaccgcttactggcaagtctgttgcagttttattaccataataaaacgcataaccataatggccactataggcttttttttctgttgctaatttggaaaagtctttccaattctcaatatagtacaaaccagaataaacgtatttttgtaaattggggtcttgtaatgctctattaggttcaagcccaattggatttgtatgtattttattttctgttttaacatttttaacatcatcttcaatcgtagaaggtgaggaaaaatatgatatatagccattttcatttaagaaactaggttctttattaccactcagattctgagccactaacttcatccctcctcctaaagaaggaatggacaacttttccaaattagattttgttcttgaacttgaagtatcgtcttgataacgtggtttagaagaggagggattagagacgtcatctacatcaaaagaaccacctcccccgctacaagcgcttaataaaaaggaaagtccaccagtgataagaggtacagatttcatagaattaatacttatacaaaattgataataattcgcattattgttctttttttgtaataatgtcaagttagagttttttaagaatatggataaaatatgaaaaatggcgtaaaacaaatttctttcttatcattaataggcttatcattaataggcttatcattaacgaatatagcttgggcaaaagttgcacgtcctaaaaatgatacactgacaaatacgattcaaagtgcggaattaaaaacctcctctttttcctctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcacgataatttcttactcacttgggcaaaggctattgacgcgcgtgaacaaggtgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtagttggaccgcttgggaaaaagaaagtgggaaggggggtagggtattctttatcagtagaaaaaaatggccatgggcagatcatttttttagtaaaactatgtttaatgggaatggaaaatattattgggataataaaaaatacaatgaggctactttgcgtataggtggtggtttaggttatcaaactgccttagttgaagtctcgttgtttccttttcaagaaaagcgttggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcatttcatcaacactattttatttacctaaaagcactcaattttggtttgttggcatggattttcatcgagaaaatacacaagcattagataatgcttatcaacaaaagacattgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaaggttgtaaactaactgttgagttatctctaacattgttaaagtgcatacactatatttttaatattagtttgaaattttttaaaaaatttctgtttcttatttgacgaacgcgcattttatgactagaattgcaccctattttattcactcttaattgtatttaggtaaattaaaatgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataatcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataatggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtatctaactggggtttagcgattatctgtgtaacaattgtagtgaaagcaattttgtatcctcttacaaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggtttagagaaaaaagggttgcattctcgtaaaaaatagtcacgaacaggcaaaaagaaaggcacggaatgtgccttttctttattttactgccgtgggtatacctaccctaggtagtagtgtacctaccctaagcaatcaaccgtgggtaagtatacccacggttaattatagtaataatagttcccctttggggaacgtcaagctctaccccaaaggggtagcactaggataaacactagggtatacttaccactaggtagtagtgtacctaccactaagcaatcaaccgtgggtaggtatacccacggttaattatagtaataatagttcccctttggggaacatcaagctctaccccaaaggggtagcactgggataaacctagggtatacttaccctaggtagtagtatacctaccctaggtagtgtgtacctaccctaagcaatcaactgtgggtaggtatacccacggttaattatagtaataatagttcccctctggggaacgtcaagctctaccccaaaggggtagcactgggataaacctagggtatacttaccctaggtagtagtatacctaccctaggtagtgtgtacctaccctaagcaatcaaccatgggtaagtatacccacggttaattatagtaataatagttcccctttggggaacgtcaagctctaccccaaaggggtagcactaggataaacctagggtatacttaccctaggtagtagtatacttaccctaggcaatcaaccgtgggtaagtatacccacggttaattatagtaatagtagttcccctttggggaacatcaagctctaccccaaaggggtagcactgggataaacctagggtatacttaccctaggtaatatcatatttccccagacaataataggttttttatgaaagaaacaatcgttgctcaagctactgcaccaggtcgtggtggcattgggattttaagggtctcagggcctttagcaacaaaagttgctcaagctatattaggtaaatgccctaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgacggaatccgtttggcgagaccaggcgagttttctgaacaagcttttttgaatgataaattggatcttgctcaagcagaggccattgcagatttaattgatgcaacatcagaacaagcggcacgctcagcattaaaatcattacaaggcgagttttctaaaaaagtaaatgaattggttgattctgtgatttatttacgtacttatgtagaagcaagcattgattttcctgatgaagaaattgatttcttggcagatggaaaaattgaagcaaatttacgcggtattattaatcagctagaaaatgttcgttctgaagctaaacaaggttctattttacgtgaggggatgaaagtcgtgattgctggtcgcccgaatgcaggcaaatcgagtttgcttaatgcacttgctggtcgcgaagcagctatcgtcacggatattgcaggtacaacccgtgatgtattgcgtgagcatattcatattgatggtatgccattgcatattattgataccgcaggtcttcgagatgcaaccgatgaagtagagcgaattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaattattagtctttctgctcaaacgcatgatggtgtaaaacttttacgtgaccatttgaaacaagcaatgggttttcaaacaggtatcgaagggggatttttagctcgtcgtcgtcatttagatgcacttgagaaagccgcagagcatttacaaatcggtttggttcaacttacagaatttcatgcaggagaacttttagcggaagaattacgcttagttcaaagctatttaagtgaaattacgggtcaattcacatccgatgatttacttggtaatatttttagttctttctgcattggaaaataggaagcgtaaagtgcggtcattttttggcaaaaatttaaatcaaaagtggcaatatttggtggtgttttgttgataggaattggtattagctggctttgtgagcatggagttttcactttttaagatgctaattttttacgtttagattataatcaggaaaattttatatttataacaagggttatagaatgttaattgaaaaaatgcacaatttaacaaactcaaaggtttctaaatttatcttaggtttgattactgtatcgtttttagttggtggaatgtctggctatctttttagctcaaatgatacttatgcggcaaaagtgaacggcgaagtgatttctcaacaagattttttaaatcgctataatcaagaatttgaaatacgcgcacaacgtgagggagaggcgtttgtggctcagtcagattctcctgaatttgttaccgcacttcgtcaaaacatcgtcaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagtgcagaagttttctttcaaaagcgtttagctcgtttagcaactttatctcttgaagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagcacatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttaatggagagtcgttatttttctttagaaaaacaagcgagtgataaggcttttgaagacagtaagtctcttaatactgcagcacaagcagcaggtgttaaggttcaagagagtgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatcgatattgaaactttcttaaaacgtcagaaagctgagaatgcgcttaatgaaaaagcacaacaagcagtgaaaaaattaagtgaaaaccctgaatcaaaagtagatggcattaatttctcaagtgagcagacttttactttaagtgaaaataaagatcctattttaacaaatggtatattttcaattgctaaaccaaaatcaaatgaagctctttatcaagtggtgcataattcaaatggcgatgtggttgttgttgccttgaataaggttgaacaaggcagtttaagtgaaaaagaattgtcgcaatttggtatgcaattattgcgtagtcatcaatctgaattacaatttcagttaatacaaggattacgtgagagagcaaaaattgaggtaaatgactctttcatcaatcaagatgatgaagtgcaacaataacaggttaaatgataatttgagataaattttgctcaaaagtgcggtaaatttcaccgcacttttttacttttgtgcaaaaggaagttaatgatgtttgggaaagaaataattcattctaaaacaatatggttttattttttgttgtttctcttttccatatttaccaatatgggattaggcaatgtattaagtgagaatattcccgtttcagattacgcaattttatttgttatcacggcgatttctttttattttaccccttggcttgggcgaatattaattactgtattattcctcagtgcgctattttattgctctgctggttttttctatggaattccatctttggggattatcgcttctgtttatgaaacgaatattaatgaaaccttagaatattacacaaccattcctttttggatatttttatttcaagttagttatatcattttatttgttgctttaatgaaattaagtttttatgttaaacaacaagcatttaaatggctaaatatggttgttatcagcctattattagttttttcttataatcaattttctaattggaactacgcctataaattccgtttttatccagttcttttttattctgaatttgatcgaatgaatgatctatatttagaacaacgagattttctaaatcaatccgttaatgcgccgtctcaatgggatattcaatcttttacgccaaaatataaaaattatattttaattattggtgaaagtatgcgaaaagattatatgtcgttatatggctttccactgaaaaccacgccatttttagagcgtgtgaaaagcacagtttttgaaaattattattctgcagcaccgaatacgcaaccgtctttacaacacaccctatatcgagcagataaaggagaaacggtttatacggataatattatttctttagccaaaaaagcgggcgtgaaaacttattggatttctaatcaaggcaaaattggggaatttgatacgatggcctctcgtattggtcaaagtgcagatgaaacgatttttatgaagccgttaggttataactctaaaaaagtttatgacgatgaaatgttgcctgtattagataaagccttaaaagaaaatattacgaatccaaaattaattgtgattcatttaatgggctcacatccagccttttgtgagcgtcttccgtacgaagttaaaaattattttattaatcaatctatgtcttgttatttagaatcgattaaatatacggatcagtttttagaaaaattaaattcgcagttagtatcgcaaaatgaaccctattcggtgatttacttttctgatcatgggcttgctcattatgaggattctgaaggtttatcattgcatccaaataatctttataaacaaaattatgaaattcctttcgttatgttttcgagtgatagtaaaaagctagaaaaaataaaaacgccacaatcggcatttaattttgtttatggttttgctgattggatgggaattaaggaaaaacatttacaaggcgtggatttcttccatcctgaaaaacaggaaattaaagtatttgattggaataacgttgtaaatgttaaagagttggctgatgatccagcaaaattaccagaagccgttcagtaaatgagatcgtgctttatcatttatcggcttgtgctagaattagcggaatttttttaaaagggaaatagtatgtccaaaaaatcagggctttcatttttatggttaagtgcggtcgctttcgtggttgatttgcttacaaaatacattgtggtacaaaaatttgatttgtatgaaagtgttaatgtgctgcctgtttttaacctgacttatgttcgaaattatggcgcagcatttagtttcttagcggatcatagtggttggcaacaatatttctttattttgttggcattggctatttcaggaatgttggtctattttttagcaaaaaataatgccgaacaaaaaatccaaaattctgcttatgcactgattattggtggggcgttagcgaatatggtagatcgcacttacaatggtttcgtcgtggatttctttgatttctattgggatatttaccattatccagtatttaatatcgccgatattgccatttgtattggcgcagggttattagcattagatgcgtttaagagcgaaaagaaaaaagtacaagataaacaagtagaaaagtgcggtcaaaaatgaagataattttagccaatccacgaggattctgtgccggtgtagaccgtgctattagtattgttgaactcgccttagaaattcatggcgcaccgatttatgttcgtcatgaagtggtgcataaccgatttgttgtgaacggattgcgtgatcgtggtgcgatcttcgtggaagaattaagcgaggtacctgatggtgcgatcgtgattttttctgcgcacggcgtatctcaagccgttcgacaagaagcgaaagaccgcaatctcaaagtatttgatgcaacctgtcctttggtgaccaaagtgcatatgcaagttgctcgtgcaagtcgaaagggaacaaaagcgattttgattggacataaaggacaccctgaagttgaaggcacaatggggcagtatagtaatgaagatggcggaattttcttgattgaaaaagtagaagatattgcacgtttgccaatgcaagacaatgatgatttaacctttatgacgcaaaccactttatcgctagatgatacagcagaaactattgctgcattaaaggaaaaatatcccgctattcaagggccacataaaaacgatatttgttatgcgacaaccaatcgtcaagaagcggtgcgagaattggctaaattatcagatttagtgttggttgtggggtctaaaaactcatcaaattcaaatcgtttaaatgaattggcgtctcgaatggggattaaatcacagcttcttgatgatccttccgatattcaagatgattggtttaatgatgtaaaaaccatagggattacagctggcgcgtctgcaccagaagaattagttcaatcgattatttcccgcttaaaaaagtttggtgcggatatatagaagggctgcaaggttaacggaatccgagtctgtattccgccaacat

(The sequence listing continues in the following parts.)

What is claimed:

1. An isolated polynucleotide comprising the nucleotide sequence of SEQ ID NO: 663.

2. A method for detecting NTHi bacteria in a biological sample comprising
   (a) contacting a polynucleotide of claim 1 with polynucleotides from a biological sample under stringent hybridization conditions, wherein the hybridization conditions comprise washing with 0.015 M sodium chloride, 0.0015 M sodium citrate at 65-68°C., and
   (b) detecting hybridization of the polynucleotide within the sample, wherein hybridization indicates the presence of NTHi bacteria in the biological sample.

3. The method of claim 2 wherein the biological sample is selected from the group consisting of serum, sputum, ear fluid, blood, urine, lymphatic fluid, and cerebrospinal fluid.

4. A vector comprising the polynucleotide of claim 1.

5. The vector of claim 4, wherein the polynucleotide is operatively linked to an expression control sequence.

6. A host cell comprising the vector of claim 4.

7. A cell comprising to vector of claim 5.

8. A host cell comprising the polynucleotide of claim 1.

* * * * *

UNITED STATES PATENT AND TRADEMARK OFFICE
CERTIFICATE OF CORRECTION

| | | |
|---|---|---|
| PATENT NO. | : 7,638,282 B2 | Page 1 of 1 |
| APPLICATION NO. | : 11/770447 | |
| DATED | : December 29, 2009 | |
| INVENTOR(S) | : Lauren O. Bakaletz et al. | |

It is certified that error appears in the above-identified patent and that said Letters Patent is hereby corrected as shown below:

At col. 1, line 10 insert --The invention was made with government support under Grant No. RO1 DC03915 awarded by the United States National Institutes of Health. The government has certain rights in the invention.--

Signed and Sealed this

Eighteenth Day of May, 2010

David J. Kappos
*Director of the United States Patent and Trademark Office*

UNITED STATES PATENT AND TRADEMARK OFFICE
CERTIFICATE OF CORRECTION

| | | |
|---|---|---|
| PATENT NO. | : 7,638,282 B2 | Page 1 of 1 |
| APPLICATION NO. | : 11/770447 | |
| DATED | : December 29, 2009 | |
| INVENTOR(S) | : Lauren O. Bakaletz et al. | |

It is certified that error appears in the above-identified patent and that said Letters Patent is hereby corrected as shown below:

Col. 1 lines 11-14:

"The invention was made with government support under Grant No. R01 DC03915 awarded by the United States National Institutes of Health. The government has certain rights in the invention." should be --

"Part of the work during the development of this invention was made with government support from the National Institutes of Health under grant number R01 DC03915. The U.S. Government has certain rights in the invention."

Signed and Sealed this
Sixth Day of November, 2012

David J. Kappos
*Director of the United States Patent and Trademark Office*